US011524066B2

(12) United States Patent
Jasny et al.

(10) Patent No.: US 11,524,066 B2
(45) Date of Patent: Dec. 13, 2022

(54) HENIPAVIRUS VACCINE

(71) Applicant: CureVac SE, Tübingen (

(56) References Cited

U.S. PATENT DOCUMENTS

| | | |
|---|---|---|
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe et al. |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351048 A1 | 11/2019 | Rauch |
| 2019/0381180 A1 | 12/2019 | Baumhof et al. |

FOREIGN PATENT DOCUMENTS

| | | |
|---|---|---|
| WO | WO 2016/203025 | 12/2016 |
| WO | WO 2017/021546 | 2/2017 |
| WO | WO 2017/137095 | 8/2017 |
| WO | WO 2017/140905 | 8/2017 |
| WO | WO 2017/186928 | 11/2017 |
| WO | WO 2017/191258 | 11/2017 |
| WO | WO 2017/212009 | 12/2017 |
| WO | WO 2018/078053 | 5/2018 |
| WO | WO 2018/096179 | 5/2018 |
| WO | WO 2018/104540 | 6/2018 |
| WO | WO 2018/167320 | 9/2018 |
| WO | WO 2018/172556 | 9/2018 |
| WO | WO 2018/211038 | 11/2018 |

OTHER PUBLICATIONS

International Preliminary Report on Patentability issued in International Application No. PCT/EP2017/084525, dated Jun. 25, 2019.
International Search Report and Written Opinion issued in International Application No. PCT/EP2017/084525, dated Jul. 20, 2018.
Petsch et al., "Protective efficacy of in vitro synthesized, specific mRNA vaccines against influenza A virus infection", *Nat. Biotechnol.*, 30(12): 1210-1216, 2012.
Rausch et al., "mRNA vaccine CV9103 and CV9104 for the treatment of prostate cancer", *Hum. Vaccin. Immunother.*, 10(11):3146-3152, 2014.

\* cited by examiner

HENIPAVIRUS VACCINE

This application is a national phase application under 35 U.S.C. § 371 of International Application No. PCT/EP2017/084525, filed Dec. 22, 2017, which claims benefit of International Application No. PCT/EP2016/082672, filed Dec. 23, 2016, the entire contents of each of which are hereby incorporated by reference.

The present invention is directed to an artificial nucleic acid and to polypeptides suitable for use in treatment or prophylaxis of an infection with Hendra virus and/or Nipah virus or a disorder related to such an infection. In particular, the present invention concerns a Hendra virus and/or Nipah virus vaccine. The present invention is directed to an artificial nucleic acid, polypeptides, compositions and vaccines comprising the artificial nucleic acid or the polypeptides. The invention further concerns a method of treating or preventing a disorder or a disease associated with a Hendra virus and/or Nipah virus infection, first and second medical uses of the artificial nucleic acid, polypeptides, compositions and vaccines. Further, the invention is directed to a kit, particularly to a kit of parts, comprising the artificial nucleic acid, polypeptides, compositions and vaccines.

Henipavirus is a genus of negative sense single stranded RNA viruses belonging to the Paramyxovirinae virus superfamily. The Henipavirus genome is about 18 kb in size, encoding for nine proteins, comprising RNA-directed RNA polymerase (L), fusion protein (F), non-structural protein (V), glycoprotein (G), nucleoprotein (N), matrix protein (M), phosphoprotein (P), protein C, and protein W. The genus currently contains five described and established species, including the pathogenic viruses Hendra virus and Nipah virus.

Hendra virus is the source of a recently emerging disease in animals and human. Hendra virus was first recognized in September 1994 after an outbreak of respiratory illness among twenty horses and two humans in Hendra, Queensland, Australia. In 1995, a second unrelated outbreak was identified that had occurred in August 1994 in Mackay, Queensland, in which two horses died and one human became. Four of the seven people who contracted the virus from infected horses have died since the disease first emerged in 1994. The fatality rate has been reported at more than 70% in horses and 50% in humans.

The Nipah virus was initially isolated in 1999 upon examining samples from an outbreak of encephalitis and respiratory illness among adult men in Malaysia and Singapore. The host for Nipah virus is still unknown, but flying foxes (bats of the *Pteropus* genus) are suspected to be the natural host. Infection with Nipah virus in humans has been associated with encephalitis characterized by fever and drowsiness and more serious central nerve system disease, such as coma, seizures and inability to maintain breathing. Illness with Nipah virus begins with 3-14 days of fever and headache, followed by drowsiness and disorientation characterized by mental confusion. These signs and symptoms can progress to coma within 24-48 hours. Some patients have had a respiratory illness during the early part of their infections. Serious nerve disease with Nipah virus encephalitis has been marked by some sequelae, such as persistent convulsions and personality changes. During a Nipah virus disease outbreak in 1998-1999, about 40% of the patients with serious nerve disease who entered hospitals died from the illness.

Hendra virus and Nipah virus, like the majority of other paramyxoviruses, possess two surface glycoproteins, a fusion protein (F) and a glycoprotein protein (G), both involved in promotion of fusion between the viral membrane and the membrane of the target host cell. Hendra viruses and Nipah viruses require both their attachment and fusion proteins to initiate membrane fusion. Various studies were conducted to understand the functions of the G and F proteins in virus infection.

Current vaccine approaches for protection from Nipah virus infection have focused on the use of Nipah virus glycoprotein (G) and/or fusion protein (F) as immunogens in various platforms, including DNA vaccines, subunit vaccines, non-replicating vectors, as well as replicating vectors.

To date, no effective antiviral therapies have been approved for either the prevention or treatment of diseases caused by Hendra virus infections and/or Nipah virus infections. Thus, there is a significant unmet medical need to find agents that can prevent Hendra virus and/or Nipah virus infection, shorten the duration of Hendra virus and/or Nipah virus-induced illness, lessen the severity of symptoms, minimize secondary bacterial infections and exacerbations of underlying disease, and reduce virus transmission. A prophylactic Hendra virus and Nipah virus vaccine should be protective against a wide variety of serotypes to reduce the number of Hendra virus and Nipah virus infections, hence, reducing the risk of a global pandemic threat.

The underlying object of the present invention is therefore to provide a Hendra virus and/or Nipah virus vaccine. It is a further preferred object of the invention to provide a Hendra virus and/or Nipah virus vaccine, which may be produced in a fast manner at an industrial scale in a potential pandemic scenario. A further object of the present invention is the provision of a storage-stable Hendra virus and/or Nipah virus vaccine. Further object of the underlying invention is to provide nucleic acid sequences, particularly mRNA sequences coding for antigenic peptides or proteins derived from a protein of a Hendra virus and/or Nipah virus or a fragment or variant thereof for the use as a vaccine for prophylaxis or treatment of Hendra virus and/or Nipah virus infections. Furthermore, it is the object of the present invention to provide an effective Hendra virus and/or Nipah virus vaccine which can be stored without cold chain and which enables rapid and scalable vaccine production which is of major importance in the context of pandemic Hendra virus and/or Nipah virus outbreaks.

The object underlying the present invention is solved by the claimed subject-matter.

Definitions

For the sake of clarity and readability the following definitions are provided. Any technical feature mentioned for these definitions may be read on each and every embodiment of the invention. Additional definitions and explanations may be specifically provided in the context of these embodiments.

Adaptive immune response: The adaptive immune response is typically understood to be an antigen-specific response of the immune system. Antigen specificity allows for the generation of responses that are tailored to specific pathogens or pathogen-infected cells. The ability to mount these tailored responses is usually maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. The three cell types that may serve as antigen-presenting cells are dendritic cells, macrophages, and B cells. Each of these cells has a distinct function in eliciting immune responses. Dendritic cells may take up antigens by phagocytosis and macropinocytosis and may become stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. MHC-molecules are, typically, responsible for presentation of an antigen to T-cells. Therein, presenting the antigen on MHC molecules leads to activation of T cells which induces their proliferation and differentiation into armed effector T cells. The most important function of effector T cells is the killing of infected cells by CD8+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which do not recognize and bind the antigen directly, but instead recognize short peptide fragments e.g. of pathogen-derived protein antigens, e.g. so-called epitopes, which are bound to MHC molecules on the surfaces of other cells.

Adaptive immune system: The adaptive immune system is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered. The system is highly adaptable because of somatic hyper mutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to long-lived specific immunity.

Adjuvant/adjuvant component: An adjuvant or an adjuvant component in the broadest sense is typically a pharmacological and/or immunological agent that may modify, e.g. enhance, the effect of other agents, such as a drug or vaccine. It is to be interpreted in a broad sense and refers to a broad spectrum of substances. Typically, these substances are able to increase the immunogenicity of antigens. For example, adjuvants may be recognized by the innate immune systems and, e.g., may elicit an innate immune response. "Adjuvants" typically do not elicit an adaptive immune response. Insofar, "adjuvants" do not qualify as antigens. Their mode of action is distinct from the effects triggered by antigens resulting in an adaptive immune response.

Antigen: In the context of the present invention "antigen" refers typically to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. In the sense of the present invention an antigen may be the product of translation of a provided nucleic acid molecule, preferably an mRNA as defined herein. In this context, also fragments, variants and derivatives of peptides and proteins comprising at least one epitope are understood as antigens.

Antigenic peptide or protein: An antigenic peptide or protein is a peptide or protein derived from a protein which may stimulate the body's adaptive immune system to provide an adaptive immune response. Therefore an antigenic peptide or protein comprises at least one epitope of the protein it is derived from.

Artificial nucleic acid molecule: The terms "artificial nucleic acid molecule" and "artificial nucleic acid" may typically be understood to be a nucleic acid molecule, e.g. a DNA or an RNA that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bicistronic nucleic acid, multicistronic nucleic acid: A bicistronic or multicistronic nucleic acid is typically an RNA or DNA, preferably an mRNA that typically may have two (bicistronic) or more (multicistronic) coding sequences. A coding sequence in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component.

Cationic component: The term "cationic component" or "cationic compound" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component, e.g. a cationic peptide, cationic polysaccharide, a cationic lipid may be any positively charged compound or polymer, preferably a cationic peptide or protein which is positively charged under physiological conditions, particularly under physiological conditions in vivo. A "cationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the conditions given.

Cap analogue: A cap analogue refers to a non-polymerizable di-nucleotide that has cap functionality in that it facilitates translation or localization, and/or prevents degradation of a nucleic acid molecule, particularly of an RNA molecule, when incorporated at the 5'-end of the nucleic acid molecule. Non-polymerizable means that the cap analogue will be incorporated only at the 5' terminus because it does not have a 5' triphosphate and therefore cannot be extended in the 3' direction by a template-dependent polymerase, particularly, by template-dependent RNA polymerase. Cap analogues include, but are not limited to, a chemical structure selected from the group consisting of m7GpppG, m7GpppA, m7GpppC; unmethylated cap analogues (e.g., GpppG); dimethylated cap analogue (e.g., m2,7GpppG), trimethylated cap analogue (e.g., m2,2,7GpppG), dimethylated symmetrical cap analogues (e.g., m7Gpppm7G), or anti reverse cap analogues (e.g., ARCA; m7,2'OmeGpppG, m7,2'dGpppG, m7,3'OmeGpppG, m7,3'dGpppG and their tetraphosphate derivatives) (Stepinski et al., 2001. RNA 7(10):1486-95). Further cap analogues have been described previously (U.S. Pat. No. 7,074,596, WO 2008/016473, WO 2008/157688, WO 2009/149253, WO 2011/015347, and WO 2013/059475). The synthesis of N7-(4-chlorophenoxyethyl) substituted dinucleotide cap analogues has been described recently (Kore et al. (2013) Bioorg. Med. Chem. 21(15): 4570-4).

5'-cap-Structure: A 5'-cap is typically a modified nucleotide (cap analogue), particularly a guanine nucleotide, added to the 5'-end of a nucleic acid molecule, particularly of an RNA molecule, e.g. an mRNA molecule. Preferably, the 5'-cap is added using a 5'-5'-triphosphate linkage (also named m7GpppN). Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4"-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety. These modified 5'-cap structures may be used in the context of the present invention to modify the mRNA sequence of the inventive composition. Further modified 5'-cap structures which may be used in the context of the present invention are cap 1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine. In the context of the present invention, a 5'-cap (cap0 or cap1) structure may also be formed in chemical RNA synthesis or RNA in vitro transcription (co-transcriptional capping) using cap analogues, or a cap structure may be formed in vitro using capping enzymes (e.g., commercially available capping kits) or using immobilized capping enzymes, e.g. in a capping reactor (WO 2016/193226).

Cellular immunity/cellular immune response: Cellular immunity relates typically to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. Such cells may be virus-infected or infected with intracellular bacteria, or cancer cells displaying tumor antigens. Further characteristics may be activation of macrophages and natural killer cells, enabling them to destroy pathogens and stimulation of cells to secrete a variety of cytokines that influence the function of other cells involved in adaptive immune responses and innate immune responses.

Chemical synthesis of nucleic acids: Chemical synthesis of relatively short fragments of oligonucleotides with defined chemical structure provides a rapid and inexpensive access to custom-made oligonucleotides of any desired sequence. Whereas enzymes synthesize DNA and RNA only in the 5' to 3' direction, chemical oligonucleotide synthesis does not have this limitation, although it is most often carried out in the opposite, i.e. the 3' to 5' direction. Currently, the process is implemented as solid-phase synthesis using the phosphoramidite method and phosphoramidite building blocks derived from protected nucleosides (A, C, G, and U), or chemically modified nucleosides. To obtain the desired oligonucleotide, the building blocks are sequentially coupled to the growing oligonucleotide chain on a solid phase in the order required by the sequence of the product in a fully automated process. Upon the completion of the chain assembly, the product is released from the solid phase to the solution, deprotected, and collected. The occurrence of side reactions sets practical limits for the length of synthetic oligonucleotides (up to about 200 nucleotide residues), because the number of errors increases with the length of the oligonucleotide being synthesized. Products are often isolated by HPLC to obtain the desired oligonucleotides in high purity. Chemically synthesized oligonucleotides find a variety of applications in molecular biology and medicine. They are most commonly used as antisense oligonucleotides, small interfering RNA, primers for DNA sequencing and amplification, probes for detecting complementary DNA or RNA via molecular hybridization, tools for the targeted introduction of mutations and restriction sites, and for the synthesis of artificial genes. Moreover, long-chain DNA molecules and long-chain RNA molecules may be chemically synthetized and used in the context of the present invention.

Cloning site: A cloning site is typically understood to be a segment of a nucleic acid molecule, which is suitable for insertion of a nucleic acid sequence, e.g., a nucleic acid sequence comprising a coding sequence. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Coding sequence: A coding sequence (cds) in the context of the invention is typically a sequence of several nucleotide triplets, which may be translated into a peptide or protein. A coding sequence preferably contains a start codon, i.e. a combination of three subsequent nucleotides coding usually for the amino acid methionine (ATG), at its 5'-end and a subsequent region which usually exhibits a length which is a multiple of 3 nucleotides. A coding sequence is preferably terminated by a stop-codon (e.g., TAA, TAG, and TGA). Typically, this is the only stop-codon of the coding sequence. Thus, a coding sequence in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The coding sequence may be isolated or it may be incorporated in a longer nucleic acid sequence, for example in a vector or an mRNA. In the context of the present invention, a coding sequence may also be termed "protein coding region", "coding sequence", "cds", "open reading frame" or "ORF".

Derived from: The phrase "derived from" as used throughout the present specification in the context of a nucleic acid, i.e. for a nucleic acid "derived from" (another) nucleic acid, means that the nucleic acid, which is derived from (another) nucleic acid, shares at least 50%, preferably at least 55%, preferably at least 60%, preferably at least 65%, preferably at least 70%, more preferably at least 75%, more preferably at least 80%, 81%, 82%, 83%, 84%, more preferably at least 85%, 86%, 87%, 88%, 89% even more preferably at least 90%, 91%, 92%, 93%, 94%, even more preferably at least 95%, 96%, 97%, and particularly preferably at least 98%, 99% sequence identity with the nucleic acid from which it is derived. The skilled person is aware that sequence identity is typically calculated for the same types of nucleic acids, i.e. for DNA sequences or for RNA sequences. Thus, it is understood, if a DNA is "derived from" an RNA or if an RNA is "derived from" a DNA, in a first step the RNA sequence is converted into the corresponding DNA sequence (in particular by replacing the uracils (U) by thymidines (T) throughout the sequence) or, vice versa, the DNA sequence is converted into the corresponding RNA sequence (in particular by replacing the thymidines (T) by uracils (U) throughout the sequence). Thereafter, the sequence identity of the DNA sequences or the sequence identity of the RNA sequences is determined. Preferably, a nucleic acid "derived from" a nucleic acid also refers to nucleic acid, which is modified in comparison to the nucleic acid from which it is derived, e.g. in order to increase RNA stability even further and/or to prolong and/or increase protein production. It goes without saying that such modifications are preferred, which do not impair RNA stability, e.g. in comparison to the nucleic acid from which it is derived.

"Different Hendra virus", "different Nipah virus", "different Henipavirus": The terms "different Hendra virus", "different Nipah virus", "different Henipavirus" in the context of the invention has to be understood as the difference between at least two respective viruses, wherein the difference is manifested on the RNA genome of the respective different virus. In the broadest sense, “different Nipah virus” has to be understood as genetically “different Nipah virus”. Similarly, “different Hendra virus” has to be understood as genetically “different Hendra virus”. Particularly, said (genetically) different viruses express at least one different protein or peptide, wherein the at least one different protein or peptide preferably differs in at least one amino acid.

“Same Henipavirus”, “same Nipah virus”, “same Hendra virus”: In the broadest sense, “same Henipavirus”, “same Nipah virus”, or “same Hendra virus” has to be understood as genetically. Particularly, said (genetically) same virus expresses the same proteins or peptides (e.g., at least one structural and/or non-structural protein), wherein all proteins or peptides have the same amino acid sequence.

DNA: DNA is the usual abbreviation for deoxy-ribonucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerize by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by NT-base-pairing and G/C-base-pairing.

Epitope: An “epitope” (also called “antigen determinant”) can be distinguished in T cell epitopes and B cell epitopes. T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens as defined herein, preferably having 5 to 15 amino acids, more preferably having 5 to 12 amino acids, even more preferably having 6 to 9 amino acids, which may be recognized by antibodies, i.e. in their native form. Such epitopes of proteins or peptides may furthermore be selected from any of the herein mentioned variants of such proteins or peptides. In this context antigenic determinants can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Fragment of a sequence: A fragment of a sequence may typically be a shorter portion of a full-length sequence of e.g. a nucleic acid sequence or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) molecule from which the fragment is derived.

Fragments of proteins: "Fragments" of proteins or peptides in the context of the present invention may, typically, comprise a sequence of a protein or peptide as defined herein, which is, with regard to its amino acid sequence (or its encoded nucleic acid molecule), N-terminally and/or C-terminally truncated compared to the amino acid sequence of the original (native) protein (or its encoded nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. In the context of antigens such fragment may have a length of about 6 to about 20 or even more amino acids, e.g. fragments as processed and presented by MHC class I molecules, preferably having a length of about 8 to about 10 amino acids, e.g. 8, 9, or 10, (or even 6, 7, 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T-cells in form of a complex consisting of the peptide fragment and an MHC molecule, i.e. the fragments are typically not recognized in their native form. Fragments of proteins or peptides (e.g. in the context of antigens) may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

G/C modified: The terms "G/C modified" or "G/C content modification" may typically be a nucleic acid, preferably an artificial nucleic acid molecule as defined herein, based on a modified wild type sequence comprising a preferably increased number of guanosine and/or cytosine nucleotides as compared to the wild type sequence. Such an increased number may be generated by substitution of codons containing adenosine or thymidine nucleotides by codons containing guanosine or cytosine nucleotides. If the enriched G/C content occurs in a coding sequence of DNA or RNA, it makes use of the degeneracy of the genetic code. Accordingly, the codon substitutions preferably do not alter the encoded amino acid residues, but exclusively increase the G/C content of the nucleic acid molecule.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an artificial nucleic acid molecule as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient.

Genetic vaccination: Genetic vaccination may typically be understood to be vaccination by administration of a nucleic acid molecule encoding an antigen or an immunogen or fragments thereof. The nucleic acid molecule may be administered to a subject's body or to isolated cells of a subject. Upon transfection of certain cells of the body or upon transfection of the isolated cells, the antigen or immunogen may be expressed by those cells and subsequently presented to the immune system, eliciting an adaptive, i.e. antigen-specific immune response. Accordingly, genetic vaccination typically comprises at least one of the steps of a) administration of a nucleic acid, preferably an artificial nucleic acid molecule as defined herein, to a subject, preferably a patient, or to isolated cells of a subject, preferably a patient, which usually results in transfection of the subject's cells either in vivo or in vitro; b) transcription and/or translation of the introduced nucleic acid molecule; and optionally c) re-administration of isolated, transfected cells to the subject, preferably the patient, if the nucleic acid has not been administered directly to the patient.

Genotype, genotype of a virus: The genetic constitution of an individual or a group or class of organisms having the same genetically consistent structure. Genotyping means determining differences in the genetic of an individual. In the context of the invention, Nipah virus genotype has to be understood as a Nipah virus having the same genetically consistent structure and Hendra virus genotype has to be understood as a Hendra virus having the same genetically consistent structure.

Heterologous sequence: Two sequences are typically understood to be "heterologous" if they are not derivable from the same gene or in the same allele. I.e., although heterologous sequences may be derivable from the same organism, they naturally (in nature) do not occur in the same nucleic acid molecule, such as in the same mRNA.

Homolog of a nucleic acid sequence: The term "homolog" of a nucleic acid sequence refers to sequences of other species than the particular sequence. E.g., in the context of the invention, it is particularly preferred that the nucleic acid sequence is derived from a Nipah virus and/or Hendra virus; therefore it is preferred that the homolog is a homolog of a respective Nipah virus or respective Hendra virus nucleic acid sequence.

Humoral immunity/humoral immune response: Humoral immunity refers typically to B-cell mediated antibody production and optionally to accessory processes accompanying antibody production. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

"Hybridizing" or "Hybridizing with a complement sequence": Nucleic acid molecules which are advantageously for the process according to the invention can be isolated based on their homology to the nucleic acid molecules or a complement sequence of the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the invention or encoding a protein used in the invention or of the nucleic acid molecule of the invention. Nucleic acid molecules with 30, 50, 100, 250 or more nucleotides may also be used. The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other species, strains, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6. According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention. A preferred, no limiting example of stringent hybridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1× 0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford. A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2×SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Some examples of conditions for DNA hybridization (Southern blot assays) and wash step are shown herein below:

(1) Hybridization conditions can be selected, for example, from the following conditions:

a) 4×SSC at 65° C.,
b) 6×SSC at 45° C.,
c) 6×SSC, 100 mg/ml denatured fragmented fish sperm DNA at 68° C.,
d) 6×SSC, 0.5% SDS, 100 mg/ml denatured salmon sperm DNA at 68° C.,
e) 6×SSC, 0.5% SDS, 100 mg/ml denatured fragmented salmon sperm DNA, 50% formamide at 42° C.,
f) 50% formamide, 4×SSC at 42° C.,
g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
h) 2× or 4×SSC at 50° C. (low-stringency condition), or
i) 30 to 40% formamide, 2× or 4×SSC at 42° C. (low-stringency condition).

(2) Wash steps can be selected, for example, from the following conditions:

a) 0.015 M NaCl/0.0015 M sodium citrate/0.1% SDS at 50° C.
b) 0.1×SSC at 65° C.
c) 0.1×SSC, 0.5% SDS at 68° C.
d) 0.1×SSC, 0.5% SDS, 50% formamide at 42° C.
e) 0.2×SSC, 0.1% SDS at 42° C.
f) 2×SSC at 65° C. (low-stringency condition).

Further, some applications have to be performed at low stringency hybridization conditions, without any consequences for the specificity of the hybridization. For example, a Southern blot analysis of total DNA could be probed with a nucleic acid molecule of the present invention and washed at low stringency (55° C. in 2×SSPE, 0.1% SDS). A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the methods of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridization conditions. Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above. The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other. To determine the percentage homology (=identity, herein used interchangeably) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid). The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms. For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTAMethods in Enzymology 183:63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences: –p Program Name [String]; –d Database [String]; default=nr; –i Query File [File In]; default=stdin; –e Expectation value (E) [Real]; default=10.0; –m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; –o BLAST report Output File [File Out] Optional; default=stdout; –F Filter query sequence (DUST with blastn, SEG with others) [String]; default=T; –G Cost to open a gap (zero invokes default behavior) [Integer]; default=0; –E Cost to extend a gap (zero invokes default behavior) [Integer]; default=0; –X X dropoff value for gapped alignment (in bits) (zero invokes default behavior); blastn 30, megablast 20, tblastx 0, all others 15 [Integer]; default=0; –I Show GI's in deflines [T/F]; default=F; –q Penalty for a nucleotide mismatch (blastn only) [Integer]; default=–3; –r Reward for a nucleotide match (blastn only) [Integer]; default=1; –v Number of database sequences to show one-line descriptions for (V) [Integer]; default=500; –b Number of database sequence to show alignments for (B) [Integer]; default=250; –f Threshold for extending hits, default if zero; blastp 11, blastn 0, blastx 12, tblastn 13; tblastx 13, megablast 0 [Integer]; default=0; –g Perfom gapped alignment (not available with tblastx) [T/F]; default=T; –Q Query Genetic code to use [Integer]; default=1; –D DB Genetic code (for tblast[nx] only) [Integer]; default=1; –a Number of processors to use [Integer]; default=1; –O SeqAlign file [File Out] Optional; –J Believe the query define [T/F]; default=F; –M Matrix [String]; default=BLOSUM62; –W Word size, default if zero (blastn 11, megablast 28, all others 3) [Integer]; default=0; –z Effective length of the database (use zero for the real size) [Real]; default=0; –K Number of best hits from a region to keep (off by default, if used a value of 100 is recommended) [Integer]; default=0; –P 0 for multiple hit, 1 for single hit [Integer]; default=0; –Y Effective length of the search space (use zero for the real size) [Real]; default=0; –S Query strands to search against database (for blast[nx], and tblastx); 3 is both, 1 is top, 2 is bottom [Integer]; default=3; –T Produce HTML output [T/F]; default=F; –l Restrict search of database to list of GI's [String] Optional; –U Use lower case filtering of FASTA sequence [T/F] Optional; default=F; –y X dropoff value for ungapped extensions in bits (0.0 invokes default behavior); blastn 20, megablast 10, all others 7 [Real]; default=0.0; –Z X dropoff value for final gapped alignment in bits (0.0 invokes default behavior); blastn/megablast 50, tblastx 0, all others 25 [Integer]; default=0; –R PSI-TBLASTN checkpoint file [File In] Optional; –n MegaBlast search [T/F]; default=F; –L Location on query sequence [String] Optional; –A Multiple Hits window size, default if zero (blastn/megablast 0, all others 40 [Integer]; default=0; –w Frame shift penalty (OOF algorithm for blastx) [Integer]; default=0; –t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351 (1987), Higgins et al., CABIOS 5, 151 (1989)) or preferably with the programs "Gap" and "Needle", which are both based on the algorithms of Needleman and Wunsch (J. Mol, Biol. 48; 443 (1970)), and "BestFit", which is based on the algorithm of Smith and Waterman (Adv. Appl. Math. 2; 482 (1981)). "Gap" and "BestFit" are part of the GCG software-package (Genetics Computer Group, 575 Science Drive, Madison, Wis., USA 53711 (1991); Altschul et al., (Nucleic Acids Res. 25, 3389 (1997)), "Needle" is part of the The European Molecular Biology Open Software Suite (EMBOSS) (Trends in Genetics 16 (6), 276 (2000)). Therefore preferably the calculations to determine the percentages of sequence homology are done with the programs "Gap" or "Needle" over the whole range of the sequences. The following standard adjustments for the comparison of nucleic acid sequences were used for "Needle": matrix: EDNAFULL, Gap_penalty: 10.0, Extend_penalty: 0.5. The following standard adjustments for the comparison of nucleic acid sequences were used for "Gap": gap weight: 50, length weight: 3, average match: 10.000, average mismatch: 0.000.

Identity of a sequence: In order to determine the percentage to which two sequences are identical, e.g. nucleic acid sequences or amino acid sequences as defined herein, preferably the amino acid sequences encoded by a nucleic acid sequence of the polymeric carrier as defined herein or the amino acid sequences themselves, the sequences can be aligned in order to be subsequently compared to one another. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Immunogen: In the context of the present invention an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid molecule, preferably an artificial nucleic acid molecule as defined herein. Typically, an immunogen elicits at least an adaptive immune response.

Immunostimulatory composition: In the context of the invention, an immunostimulatory composition may be typically understood to be a composition containing at least one component which is able to induce an immune response or from which a component which is able to induce an immune response is derivable. Such immune response may be preferably an innate immune response or a combination of an adaptive and an innate immune response. Preferably, an immunostimulatory composition in the context of the invention contains at least one artificial nucleic acid molecule, more preferably an RNA, for example an mRNA molecule. The immunostimulatory component, such as the mRNA may be complexed with a suitable carrier. Thus, the immunostimulatory composition may comprise an mRNA/carrier-complex. Furthermore, the immunostimulatory composition may comprise an adjuvant and/or a suitable vehicle for the immunostimulatory component, such as the mRNA.

Immunostimulatory RNA: An immunostimulatory RNA (isRNA) in the context of the invention may typically be an RNA that is able to induce an innate immune response itself. It usually does not have an open reading frame and thus does not provide a peptide-antigen or immunogen but elicits an innate immune response e.g. by binding to a specific kind of Toll-like-receptor (TLR) or other suitable receptors. However, of course also mRNAs having an open reading frame and coding for a peptide/protein (e.g. an antigenic function) may induce an innate immune response and, thus, may be immunostimulatory RNAs.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Innate immune system: The innate immune system, also known as non-specific (or unspecific) immune system, typically comprises the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g., activated by ligands of Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. The pharmaceutical composition according to the present invention may comprise one or more such substances. Typically, a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system; and/or acting as a physical and chemical barrier to infectious agents.

Jet injection: The term "jet injection", as used herein, refers to a needle-free injection method, wherein a fluid containing at least one inventive nucleic acid sequence (e.g., RNA, DNA, mRNA) and, optionally, further suitable excipients is forced through an orifice, thus generating an ultra-fine liquid stream of high pressure that is capable of penetrating mammalian skin and, depending on the injection settings, subcutaneous tissue or muscle tissue. In principle, the liquid stream forms a hole in the skin, through which the liquid stream is pushed into the target tissue. Preferably, jet injection is used for intradermal, subcutaneous or intramuscular injection of the mRNA sequence according to the invention. In a preferred embodiment, jet injection is used for intramuscular injection of the mRNA sequence according to the invention. In a further preferred embodiment, jet injection is used for intradermal injection of the mRNA sequence according to the invention.

Monocistronic nucleic acid: A monocistronic nucleic acid may typically be a DNA or RNA, particularly an mRNA that comprises only one coding sequences. A coding sequence in this context is a sequence of several nucleotide triplets (codons) that can be translated into a peptide or protein.

Monovalent/monovalent vaccine: A monovalent vaccine, also called univalent vaccine, is designed against a single antigen for a single organism. The term "monovalent vaccine" includes the immunization against a single valence. In the context of the invention, a monovalent Nipah virus vaccine would comprise a vaccine comprising an artificial nucleic acid encoding one single antigenic peptide or protein derived from one specific Nipah virus strain and a monovalent Hendra virus vaccine would comprise a vaccine comprising an artificial nucleic acid encoding one single antigenic peptide or protein derived from one specific Hendra virus strain Nucleic acid molecule: A nucleic acid molecule is a molecule comprising, preferably consisting of nucleic acid components. The term nucleic acid molecule preferably refers to DNA or RNA molecules. It is preferably used synonymous with the term "polynucleotide". Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Nucleic acid sequence/amino acid: The sequence of a nucleic acid molecule is typically understood to be the particular and individual order, i.e. the succession of its nucleotides. The sequence of a protein or peptide is typically understood to be the order, i.e. the succession of its amino acids.

Orthologues and paralogues: Orthologues and paralogues (of a sequence) encompass evolutionary concepts used to describe the ancestral relationships of genes and their corresponding gene products (proteins). Paralogues are genes (or proteins) within the same species that have originated through duplication of an ancestral gene; orthologues are genes (or proteins) from different organisms that have originated through speciation, and are also derived from a common ancestral gene. In the context of the invention, an orthologue and/or a paralogue of a Nipah virus nucleic acid sequence of the invention refers to a sequence having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence as represented by SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1275-1281, 1286-1292, 1301-1307, 1312-1318, 1327-1333, 1338-1344, 1353-1359, 1364-1370, 1379-1385, 1390-1396, 1405-1411, 1416-1422, 1431-1437, 1457-1463, 1483-1489, 1442-1448, 1468-1474, 1494-1500, 1516-1539, 1540-1548. In the context of the invention, an orthologue and/or a paralogue of a Nipah virus amino acid sequence of the invention refers to a sequence having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence as represented by SEQ ID NOs: 1-7, 12-18, 573-579, 584-590, 807-813, 818-824, 1041-1047, 1052-1058, 1513-1515. In the context of the invention, an orthologue and/or a paralogue of a Hendra virus nucleic acid sequence of the invention refers to a sequence having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence as represented by SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274, 1282-1285, 1293-1300, 1308-1311, 1319-1326, 1334-1337, 1345-1352, 1360-1363, 1371-1378, 1386-1389, 1397-1404, 1412-1415, 1423-1430, 1438-1441, 1464-1467, 1490-1493, 1449-1456, 1475-1482, 1501-1508. In the context of the invention, an orthologue and/or a paralogue of a Hendra virus amino acid sequence of the invention refers to a sequence having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence as represented by SEQ ID NOs: 8-11, 19-26, 580-583, 591-598, 814-817, 825-832, 1048-1051, 1059-1066.

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and 600 monomeric units. The term "polypeptide" as used herein, however, is typically not limited by the length of the molecule it refers to. In the context of the present invention, the term "polypeptide" may also be used with respect to peptides comprising less than 50 (e.g., 10) amino acids or peptides comprising even more than 600 amino acids.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein: A protein typically comprises one or more peptides or polypeptides. A protein is typically folded into 3-dimensional form, which may be required for the protein to exert its biological function.

Poly(A) sequence: A poly(A) sequence, also called poly (A) tail or 3'-poly(A) tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. A poly(A) sequence is typically located at the 3'-end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector. Moreover, poly(A) sequences, or poly(A) tails may be generated in vitro by enzymatic polyadenylation of the RNA, e.g. using Poly(A)polymerases (PAP) derived from *Escherichia coli* or yeast. In addition, polyadenylation of RNA can be achieved by using immobilized PAP enzymes e.g. in a polyadenylation reactor (WO/ 2016/174271).

Poly(C) sequence: A poly(C) sequence is typically a long sequence of cytosine nucleotides, typically about 10 to about 200 cytosine nucleotides, preferably about 10 to about 100 cytosine nucleotides, more preferably about 10 to about 70 cytosine nucleotides or even more, preferably about 20 to about 50, or even about 20 to about 30 cytosine nucleotides. A poly(C) sequence may preferably be located 3' of the coding sequence comprised by a nucleic acid.

Polyadenylation: Polyadenylation is typically understood to be the addition of a poly(A) sequence to a nucleic acid molecule, such as an RNA molecule, e.g. to a premature mRNA. Polyadenylation may be induced by a so called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Polyvalent/polyvalent vaccine: A polyvalent vaccine, called also multivalent vaccine, containing antigens from more than one strain of a virus, or different antigens of the same virus, or any combination thereof. The term "polyvalent vaccine" describes that this vaccine has more than one valence. In the context of the invention, a polyvalent Nipah virus vaccine would comprise a vaccine comprising an artificial nucleic acid encoding antigenic peptides or proteins derived from several different Nipah virus strains or comprising artificial nucleic acid encoding different antigens from the same Nipah virus strain, or a combination thereof. In preferred embodiment, a polyvalent Nipah virus vaccine comprises 2, 3, 4, 5, 6, 7, 8, 9, 10 or even more different artificial nucleic acids each encoding at least one different antigenic peptide or protein. A polyvalent Hendra virus vaccine would comprise a vaccine comprising an artificial nucleic acid encoding antigenic peptides or proteins derived from several different Hendra virus strains or comprising artificial nucleic acid encoding different antigens from the same Hendra virus strain, or a combination thereof. In preferred embodiment, a polyvalent Hendra virus vaccine comprises 2, 3, 4, 5, 6, 7, 8, 9, 10 or even more different artificial nucleic acids each encoding at least one different antigenic peptide or protein. A polyvalent Henipavirus vaccine would comprise a vaccine comprising an artificial nucleic acid encoding antigenic peptides or proteins derived from several different Henipavirus strains or comprising artificial nucleic acid encoding different antigens from the same Henipavirus strain, or a combination thereof. In preferred embodiment, a polyvalent Henipavirus vaccine comprises 2, 3, 4, 5, 6, 7, 8, 9, 10 or even more different artificial nucleic acids each encoding at least one different antigenic peptide or protein (e.g., at least one derived from Nipah virus and at least one derived from Hendra virus).

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. Typically, transcription of DNA usually results in the so-called premature RNA which has to be processed into so-called messenger-RNA, usually abbreviated as mRNA. Processing of the premature RNA, e.g. in eukaryotic organisms, comprises a variety of different post-transcriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, a coding sequence, a 3'-UTR and a poly(A)sequence. Aside from messenger RNA, several non-coding types of RNA exist which may be involved in regulation of transcription and/or translation.

RNA in vitro transcription: The terms "RNA in vitro transcription" or "in vitro transcription" relate to a process wherein RNA is synthesized in a cell-free system (in vitro). DNA, particularly plasmid DNA, is used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase. Particular examples of DNA-dependent RNA polymerases are the T7, T3, and SP6 RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, for example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis. Methods for in vitro transcription are known in the art (see, e.g., Geall et al. (2013) Semin. Immunol. 25(2): 152-159; Brunelle et al. (2013) Methods Enzymol. 530:101-14). Reagents used in said method typically include:
1) a linearized DNA template with a promoter sequence that has a high binding affinity for its respective RNA polymerase such as bacteriophage-encoded RNA polymerases;
2) ribonucleoside triphosphates (NTPs) for the four bases (adenine, cytosine, guanine and uracil); 3) optionally, a cap analogue as defined above (e.g. m7G(5')ppp(5')G (m7G));
4) a DNA-dependent RNA polymerase capable of binding to the promoter sequence within the linearized DNA template (e.g. T7, T3 or SP6 RNA polymerase);
5) optionally, a ribonuclease (RNase) inhibitor to inactivate any contaminating RNase;
6) optionally, a pyrophosphatase to degrade pyrophosphate, which may inhibit transcription;
7) $MgCl_2$, which supplies $Mg^{2+}$ ions as a co-factor for the polymerase;
8) a buffer to maintain a suitable pH value, which can also contain antioxidants (e.g. DTT), and/or polyamines such as spermidine at optimal concentrations.

Sequence identity: Two or more sequences are identical if they exhibit the same length and order of nucleotides or amino acids. The percentage of identity typically describes the extent, to which two sequences are identical, i.e. it typically describes the percentage of nucleotides that correspond in their sequence position with identical nucleotides of a reference sequence. In order to determine the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. Hence, in the context of the present invention, identity of sequences preferably relates to the percentage of nucleotides of a sequence which have the same position in two or more sequences having the same length. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Serotype, serotype of a virus: A serotype or a serotype of a virus is a group of viruses classified together based on their antigens on the surface of the virus, allowing the epidemiologic classification of organisms to the sub-species level.

Strain, strain of a virus: A strain or a strain of a virus is a group of viruses that are genetically distinct from other groups of the same species. The strain that is defined by a genetic variant is also defined as a "subtype".

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vaccine: A vaccine is typically understood to be a prophylactic or therapeutic material providing at least one antigen, preferably an immunogen. The antigen or immunogen may be derived from any material that is suitable for vaccination. For example, the antigen or immunogen may be derived from a pathogen, such as from bacteria or virus particles etc., or from a tumor or cancerous tissue. The antigen or immunogen stimulates the adaptive immune system of a mammalian subject to provide an adaptive immune response. In the context of the present invention, the antigen is preferably provided via an artificial nucleic acid.

Variant of a nucleic acid sequence: A variant of a nucleic acid sequence refers to a variant of nucleic acid sequences which forms the basis of a nucleic acid sequence. For example, a variant nucleic acid sequence may exhibit one or more nucleotide deletions, insertions, additions and/or substitutions compared to the nucleic acid sequence from which the variant is derived. Preferably, a variant of a nucleic acid sequence is at least 40%, preferably at least 50%, more preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 70%, 75%, 80%, 85%, 90%, 95%, 98% or 99% nucleotide identity over a stretch of 10, 20, 30, 50, 75 or 100 nucleotide of such nucleic acid sequence.

Variants of proteins: "Variants" of proteins or peptides as defined in the context of the present invention may be generated, having an amino acid sequence which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. "Variants" of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term variants as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam). A "variant" of a protein or peptide may have at least 70%, 75%, 80%, 85%, 90%, 95%, 98% or 99% amino acid identity over a stretch of 10, 20, 30, 50, 75 or 100 amino acids of such protein or peptide. Furthermore, variants of proteins or peptides as defined herein, which may be encoded by a nucleic acid molecule, may also comprise those sequences, wherein nucleotides of the encoding nucleic acid sequence are exchanged according to the degeneration of the genetic code, without leading to an alteration of the respective amino acid sequence of the protein or peptide, i.e. the amino acid sequence or at least part thereof may not differ from the original sequence within the above meaning. Preferably, a variant of a protein comprises a functional variant of the protein, which means that the variant exerts the same effect or functionality as the protein it is derived from.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising a coding sequence. Such vectors may be storage vectors, expression vectors, cloning vectors, transfer vectors etc. A storage vector is a vector which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding sequence and the 3'-UTR and/or the 5'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid which is suitable for storing, transporting, and/or administering a pharmaceutically active compound.

3'-untranslated region (3'-UTR): Generally, the term "3'-UTR" refers to a part of a nucleic acid molecule, which is located 3' (i.e. "downstream") of a coding sequence and which is not translated into protein. Typically, a 3'-UTR is the part of an mRNA which is located between the protein coding sequence (coding region or coding sequence (CDS)) and the poly(A) sequence of the mRNA. In the context of the invention, the term 3'-UTR may also comprise elements, which are not encoded in the template, from which an RNA is transcribed, but which are added after transcription during maturation, e.g. a poly(A) sequence. A 3'-UTR of the mRNA is not translated into an amino acid sequence. The 3'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'-capping, splicing the pre-mature mRNA to excize optional introns and modifications of the 3'-end, such as polyadenylation of the 3'-end of the pre-mature mRNA and optional endo-/or exonuclease cleavages etc. In the context of the present invention, a 3'-UTR corresponds to the sequence of a mature mRNA which is located between the stop codon of the protein coding sequence, preferably immediately 3' to the stop codon of the protein coding sequence, and the poly(A) sequence of the mRNA. The term "corresponds to" means that the 3'-UTR sequence may be an RNA sequence, such as in the mRNA sequence used for defining the 3'-UTR sequence, or a DNA sequence which corresponds to such RNA sequence. In the context of the present invention, the term "a 3'-UTR of a gene", is the sequence which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR. Preferably, the 3'-UTRs have a length of more than 20, 30, 40 or 50 nucleotides.

5'-untranslated region (5'-UTR): Generally, the term "5'-UTR" refers to a part of a nucleic acid molecule, which is located 5' (i.e. "upstream") of a coding sequence and which is not translated into protein. A 5'-UTR is typically understood to be a particular section of messenger RNA (mRNA), which is located 5' of the coding sequence of the mRNA. Typically, the 5'-UTR starts with the transcriptional start site and ends one nucleotide before the start codon of the coding sequence. Preferably, the 5'-UTRs have a length of more than 20, 30, 40 or 50 nucleotides. The 5'-UTR may comprise elements for controlling gene expression, also called regulatory elements. Such regulatory elements may be, for example, ribosomal binding sites. The 5'-UTR may be post-transcriptionally modified, for example by addition of a 5'-cap. A 5'-UTR of the mRNA is not translated into an amino acid sequence. The 5'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'-capping, splicing the pre-mature mRNA to excise optional introns and modifications of the 3'-end, such as polyadenylation of the 3'-end of the pre-mature mRNA and optional endo-/or exonuclease cleavages etc. In the context of the present invention, a 5'-UTR corresponds to the sequence of a mature mRNA which is located between the start codon and, for example, the 5'-cap. Preferably, the 5'-UTR corresponds to the sequence which extends from a nucleotide located 3' to the 5'-cap, more preferably from the nucleotide located immediately 3' to the 5'-cap, to a nucleotide located 5' to the start codon of the protein coding sequence, preferably to the nucleotide located immediately 5' to the start codon of the protein coding sequence. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence which corresponds to such RNA sequence. In the context of the present invention, the term "a 5'-UTR of a gene" is the sequence which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence (both sense and antisense strand and both mature and immature) of the 5'-UTR.

5'-terminal oligopyrimidine tract (TOP): The 5'-terminal oligopyrimidine tract (TOP) is typically a stretch of pyrimidine nucleotides located in the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. Messenger RNA that contains a 5' terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5' TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TOP genes and TOP mRNAs, the TOP-motif preferably starts at its 5'-end with the transcriptional start site and ends one nucleotide 5' to the first purin residue in said gene or mRNA. A TOP motif in the sense of the present invention is preferably located at the 5'-end of a sequence which represents a 5'-UTR or at the 5'-end of a sequence which codes for a 5'-UTR. Thus, preferably, a stretch of 3 or more pyrimidine nucleotides is called "TOP motif" in the sense of the present invention if this stretch is located at the 5'-end of a respective sequence, such as the artificial nucleic acid molecule, the 5'-UTR element of the artificial nucleic acid molecule, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif".

TOP gene: TOP genes are typically characterised by the presence of a 5' terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-cap to the nucleotide located 5' to the start codon. A 5'-UTR of a TOP gene typically does not comprise any start codons, preferably no upstream AUGs (uAUGs) or upstream coding sequences (uORFs). Therein, upstream AUGs and upstream coding sequences are typically understood to be AUGs and coding sequences that occur 5' of the start codon (AUG) of the coding sequence that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID NOs: 1-1363 of the patent application WO2013/143700, whose disclosure is incorporated herewith by reference. In this context a particularly preferred fragment of a 5'-UTR of a TOP gene is a 5'-UTR of a TOP gene lacking the 5'TOP motif. The terms "5'-UTR of a TOP gene" or "5'-TOP UTR" preferably refer to the 5'-UTR of a naturally occurring TOP gene.

Short Description of the Invention

The present invention is based on the surprising finding that at least one Henipavirus peptide or protein, particularly at least one Hendra virus and/or Nipah virus peptide or protein encoded by an artificial nucleic acid can efficiently be expressed in a mammalian cell. Further unexpectedly, the artificial nucleic acid, e.g. an mRNA sequence of the invention, is suitable for eliciting an immune response against Hendra virus and/or Nipah virus in a mammalian subject, in particular, in a human subject. The artificial nucleic acid invention, the composition comprising said artificial nucleic acid, and the vaccine induces very efficiently antigen-specific immune responses against the encoded antigenic peptide or protein. Moreover, the artificial nucleic acid invention, the composition comprising said artificial nucleic acid, and the vaccine can be stored without cold chain (lyophilizable) enabling rapid and scalable vaccine production which is of major importance in the context of pandemic Hendra virus and/or Nipah virus outbreaks.

In a first aspect, the present invention relates to artificial nucleic acids comprising at least one coding sequence encoding at least one antigenic peptide or protein derived from a Henipavirus or a fragment or variant thereof, wherein the at least one antigenic peptide or protein comprises or consists of a Henipavirus RNA-directed RNA polymerase (L), Henipavirus fusion protein (F), Henipavirus non-structural protein (V), Henipavirus glycoprotein (G), Henipavirus nucleoprotein (N), Henipavirus matrix protein (M), Henipavirus phosphoprotein (P), Henipavirus protein C, and Henipavirus protein W, or a fragment or variant of any of these.

In a preferred embodiment, the invention relates to an artificial nucleic acid comprising at least one coding sequence encoding at least one antigenic peptide or protein derived from glycoprotein and/or fusion protein of a Henipavirus or a fragment or variant thereof.

In a preferred embodiment, the Henipavirus is Nipah virus or Hendra virus.

In another preferred embodiment, the at least one antigenic peptide or protein comprises or consists of a Hendra virus fusion protein, and/or Hendra virus glycoprotein, and/or Nipah virus fusion protein and/or Nipah virus glycoprotein, a fragment or variant of any of these.

The at least one antigenic peptide or protein, provided by the artificial nucleic acid, may additionally comprise an N-terminal heterologous signal peptide, preferably selected from an IgE-leader or an HA-A signal peptide, to improve secretion of the antigenic peptide or protein.

The artificial nucleic acid may be monocistronic, bicistronic or multicistronic.

The artificial nucleic acid sequence according to the invention may be a modified nucleic acid sequence.

The artificial nucleic acid may comprises an untranslated region (UTR), e.g. a 3'-UTR and/or 5'-UTR, preferably a heterologous 3'-UTR and/or 5'-UTR, preferably derived from a gene encoding a stable mRNA.

In a preferred embodiment, the artificial nucleic acid is an RNA, preferably an mRNA, wherein the RNA is a stabilized RNA.

The artificial nucleic acid may further comprise a 5'-cap structure, and/or a 5'-UTR, and/or a Poly(A)sequence and/or a Poly(C) sequence and/or a histone stem-loop, and/or a 3'-UTR.

In another aspect, the invention relates to a composition comprising at least one artificial nucleic acid as described herein and at least one pharmaceutically acceptable carrier.

The composition may comprise a plurality or at least more than one of the artificial nucleic acids encoding a different antigenic peptide or protein derived from a Henipavirus or from a homolog, fragment or variant thereof, wherein the Henipavirus may be selected from Hendra virus and/or Nipah virus.

The artificial nucleic acid comprised in the composition may additionally be complexed with one or more cationic or polycationic component, preferably with cationic or polycationic polymers, cationic or polycationic peptides or proteins, e.g. protamine, cationic or polycationic lipids.

In an embodiment, the at least one artificial nucleic acid is complexed with protamine.

In an embodiment, the at least one artificial nucleic acid of the invention is complexed with a polymeric, preferably a polymer (e.g. peptide polymer) in conjunction with a lipidoid (e.g. 3-C12 OH).

The composition may comprise at least one protamine complexed artificial nucleic acid and at least one free artificial nucleic acid, wherein the molar ratio of the complexed nucleic acid to the free nucleic acid about 1:1.

In another embodiment, the composition may comprise the artificial nucleic acid of the invention complexed with one or more lipids, thereby forming liposomes, lipid nanoparticles and/or lipoplexes.

The composition may further comprise at least one adjuvant component.

The present invention is also directed to the use of the artificial nucleic acid in treatment or prophylaxis of an infection with Henipavirus.

In particular, the present invention is directed to the use of the artificial nucleic acid in treatment or prophylaxis of an infection with Hendra virus or a disorder related to such an infection.

Moreover, the present invention is directed to the use of the artificial nucleic acid in treatment or prophylaxis of an infection with Nipah virus or a disorder related to such an infection.

The present invention also concerns a Henipavirus vaccine, in particular a Nipah virus vaccine and a Hendra virus vaccine.

The invention further concerns a method of treating or preventing a disorder or a disease in a mammalian subject or an avian subject, first and second medical uses of the artificial nucleic acid, compositions and vaccines. Further, the invention is directed to a kit, particularly to a kit of parts, comprising the artificial nucleic acid, compositions and vaccines.

DETAILED DESCRIPTION OF THE INVENTION

The present application is filed together with a sequence listing in electronic format, which is part of the description of the present application. The information contained in the electronic format of the sequence listing filed together with this application is incorporated herein by reference in its entirety. Where reference is made herein to a "SEQ ID NO:" the corresponding nucleic acid sequence or amino acid (aa) sequence in the sequence listing having the respective identifier is referred to. For many sequences, the sequence listing also provides detailed information, e.g. regarding certain structural features, sequence optimizations, GenBank identifiers, or regarding its coding capacity. In particular, such information may be provided under the identifier <223> in the sequence listing. Accordingly, information provided under identifier <223> is explicitly included herein in its entirety and has to be understood as part of the description of the invention.

In a first aspect, the invention relates to an artificial nucleic acid comprising at least one coding sequence encoding at least one antigenic peptide or protein derived from a Henipavirus or a fragment or variant thereof.

Henipavirus:

In the context of the present invention, the term "Henipavirus" comprises any Henipavirus irrespective of genotype, species, strain, isolate, or serotype (NCBI taxonomy ID: 260964). Preferably, the term Henipavirus relates to a virus genus comprising virus strains selected from Cedar henipavirus or Cedar virus (NCBI taxonomy ID: 1221391), Ghanaian bat henipavirus or Bat paramyxovirus (NCBI taxonomy ID: 665603), Mojiang henipavirus or Mojiang virus (NCBI taxonomy ID: 1474807), Hendra virus (NCBI taxonomy ID: 928303), Nipah virus (NCBI taxonomy ID: 121791).

Henipavirus Peptides or Proteins:

Henipavirus is a genus of negative sense single stranded RNA viruses belonging to the Paramyxovirinae virus superfamily (NCBI Taxonomy ID: 11158). The Henipavirus genome is about 18 kb in size, encoding for nine proteins, comprising RNA-directed RNA polymerase (L), fusion protein (F), non-structural protein (V), glycoprotein (G), nucleoprotein (N), matrix protein (M), phosphoprotein (P), protein C, and protein W.

In particular, the term "Henipavirus protein" as used herein comprises or consists of an individual structural or non-structural Henipavirus protein. A Henipavirus peptide or protein in the meaning of the present invention may be any full length protein or fragment derived from Henipavirus RNA-directed RNA polymerase (L), Henipavirus fusion protein (F), Henipavirus non-structural protein (V), Henipavirus glycoprotein (G), Henipavirus nucleoprotein (N), Henipavirus matrix protein (M), Henipavirus phosphoprotein (P), Henipavirus protein C, and Henipavirus protein W.

Accordingly, the term "Henipavirus protein" as used in the present invention may relate to an amino acid sequence corresponding to any Henipavirus RNA-directed RNA polymerase (L), Henipavirus fusion protein (F), Henipavirus non-structural protein (V), Henipavirus glycoprotein (G), Henipavirus nucleoprotein (N), Henipavirus matrix protein (M), Henipavirus phosphoprotein (P), Henipavirus protein C, and Henipavirus protein W.

The term "Henipavirus antigenic peptide or protein" as used in the present invention may relate to an amino acid sequence corresponding to any Henipavirus RNA-directed RNA polymerase (L), Henipavirus fusion protein (F), Henipavirus non-structural protein (V), Henipavirus glycoprotein (G), Henipavirus nucleoprotein (N), Henipavirus matrix protein (M), Henipavirus phosphoprotein (P), Henipavirus protein C, and Henipavirus protein W capable. Any Henipavirus peptide or protein provided herein, or any a fragment or variant thereof, can cause an immune response when administered to a subject. Therefore, all Henipavirus proteins or peptides provided herein can be considered as antigens in the context of the present invention.

Any Henipavirus peptide or protein provided herein, or any a fragment or variant thereof, can cause an immune response when administered to a subject. Therefore, all Henipavirus proteins or peptides provided herein can be considered as antigens in the context of the present invention.

In an embodiment, the Henipavirus peptide or protein as defined above is selected from Cedar henipavirus or Cedar virus (NCBI taxonomy ID: 1221391), Ghanaian bat henipavirus or Bat paramyxovirus (NCBI taxonomy ID: 665603), Mojiang henipavirus or Mojiang virus (NCBI taxonomy ID: 1474807), Hendra virus (NCBI taxonomy ID: 928303), Nipah virus (NCBI taxonomy ID: 121791).

Accordingly, in preferred embodiments, the artificial nucleic acid as defined herein, comprising at least one coding sequence encoding at least one antigenic peptide or protein, wherein the at least one antigenic peptide or protein comprises or consists of a RNA-directed RNA polymerase (L), fusion protein, non-structural protein, glycoprotein, nucleoprotein, matrix protein, phosphoprotein, protein C, and protein W, or a fragment or variant of any of these.

In embodiments, the Henipavirus is selected from Hendra virus (NCBI taxonomy ID: 928303) and Nipah virus (NCBI taxonomy ID: 121791).

Accordingly, in a preferred embodiment, the Henipavirus peptide or protein is selected from a Hendra virus peptide or protein or Nipah virus peptide or protein.

More preferably, the at least one antigenic peptide or protein comprises or consists of a Hendra virus fusion protein, and/or Hendra virus glycoprotein, and/or Nipah virus fusion protein and/or Nipah virus glycoprotein, a fragment or variant of any of these.

In preferred embodiments, the at least one encoded antigenic peptide or protein comprises at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 573-598, 807-832, 1041-1066, 1513-1515 or provided in Table 1, Table 1B, Table 2, and Table 2B, or a fragment or variant or orthologue or paralogue of any of these.

Hendra Virus Peptides or Proteins:

The term "Hendra virus protein" or "Hendra virus protein" as used in the present invention may relate to an amino acid sequence corresponding to any Hendra virus RNA-directed RNA polymerase (L), Hendra virus fusion protein (F), Hendra virus non-structural protein (V), Hendra virus glycoprotein (G), Hendra virus nucleoprotein (N), Hendra virus matrix protein (M), Hendra virus phosphoprotein (P), Hendra virus protein C, and Hendra virus protein W.

Any Hendra virus peptide or protein provided herein, or any a fragment or variant thereof, can cause an immune response when administered to a subject. Therefore, all Hendra virus proteins or peptides provided herein can be considered as antigens in the context of the present invention.

In some embodiments described herein, the at least one Hendra virus antigenic peptide or protein encoded by the at least one coding sequence of the artificial nucleic acid may consist of an individual Hendra virus protein, the amino acid sequence of which does typically not comprise an N-terminal Methionine residue. It is thus understood that the phrase "artificial nucleic acid comprising at least one coding sequence encoding at least antigenic peptide or protein derived from a Hendra virus . . . " relates to a protein or peptide comprising the amino acid sequence of said Hendra virus protein and—if the amino acid sequence of the respective Hendra virus protein does not comprise such an N-terminal Methionine residue—an introduced N-terminal Methionine residue.

In the context of the present invention a fragment of a protein or a variant thereof encoded by the at least one coding sequence of the artificial nucleic acid according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of the respective naturally occurring full-length Hendra virus protein or a variant thereof, preferably as disclosed in Table 1 or Table 1B.

In a preferred embodiment, the at least one coding sequence of the artificial nucleic acid sequence according to the invention preferably encodes Hendra virus proteins selected from the proteins provided in Table 1 or Table 1B, or a fragment or variant thereof. Any Hendra virus protein provided in Table 1 or Table 1B, or any a fragment or variant thereof, can cause an immune response when administered to an individual. Therefore, all Hendra virus proteins provided in Table 1 or Table 1B can be considered as preferred Hendra virus antigens in the context of the present invention.

It is further preferred that the at least one coding sequence of the artificial nucleic acid sequence of the present invention encodes a Hendra virus protein or peptide, or a fragment or variant thereof, wherein the Hendra virus protein or peptide is an antigen selected from the antigens listed in Table 1. Therein, each row corresponds to a Hendra virus antigenic peptide or protein as identified by the respective gene name (first column "Name") and the NCBI database accession number of the corresponding protein (second column "Accession No."). The third column ("A", "Protein") in Table 1 indicates the SEQ ID NOs corresponding to the respective amino acid sequence as provided herein. The SEQ ID NOs corresponding to the nucleic acid sequence of the wild type nucleic acid sequence encoding the Hendra virus antigenic protein or peptide is indicated in the fourth column ("B", "CDS wt"). The following columns ("C"-"J") provides the SEQ ID NOs corresponding to modified nucleic acid sequences (opt1, opt2, opt3, opt4, opt5, opt6, opt7) of the nucleic acid sequences as described herein that encode the Hendra virus protein or peptide preferably having the amino acid sequence as defined by the SEQ ID NOs indicated in the third column ("A") or by the database entry indicated in the second column ("Accession No."). Additional information regarding each of the sequences provided in Table 1 may also be derived from the sequence listing, in particular from the details provided therein under identifier <223>.

TABLE 1

List of Hendra virus antigens:

| Name | Accession No. | A Protein | B CDS wt | C opt1 | D opt2 | E opt3 | F opt4 | G opt5 | H opt6 | J opt7 |
|---|---|---|---|---|---|---|---|---|---|---|
| F | NP_047111.2 | 8 | 34 | 60 | 86 | 112 | 138 | 164 | 190 | 216 |
| F | AEB21233.1 | 9 | 35 | 61 | 87 | 113 | 139 | 165 | 191 | 217 |
| F | AEQ38114.1 | 10 | 36 | 62 | 88 | 114 | 140 | 166 | 192 | 218 |
| F | AAB39505.1 | 11 | 37 | 63 | 89 | 115 | 141 | 167 | 193 | 219 |
| G | NP_047112.2 | 19 | 45 | 71 | 97 | 123 | 149 | 175 | 201 | 227 |
| G | AEB21225.1 | 20 | 46 | 72 | 98 | 124 | 150 | 176 | 202 | 228 |
| G | AEB21216.1 | 21 | 47 | 73 | 99 | 125 | 151 | 177 | 203 | 229 |
| G | AEB21206.1 | 22 | 48 | 74 | 100 | 126 | 152 | 178 | 204 | 230 |
| G | AEQ38052.1 | 23 | 49 | 75 | 101 | 127 | 153 | 179 | 205 | 231 |
| G | AEQ38115.1 | 24 | 50 | 76 | 102 | 128 | 154 | 180 | 206 | 232 |
| G | AEQ38108.1 | 25 | 51 | 77 | 103 | 129 | 155 | 181 | 207 | 233 |
| G | AAV80426.1 | 26 | 52 | 78 | 104 | 130 | 156 | 182 | 208 | 234 |

According to preferred embodiments, the inventive artificial nucleic acid comprises or consists of at least one coding sequence encoding at least one Hendra virus antigenic peptide or peptide as described herein, wherein the at least one Hendra virus antigenic peptide or protein comprises at least one amino acid sequence being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 8-11, 19-26, 580-583, 591-598, 814-817, 825-832, 1048-1051, 1059-1066 or a fragment or variant or orthologue or paralogue of any of these.

According to a preferred embodiment, the inventive artificial nucleic acid comprises or consists of at least one coding sequence encoding at least one Hendra virus antigenic peptide or peptide as described herein, wherein the at least one Hendra virus antigenic peptide or protein comprises an amino acid sequence according to any one of SEQ ID NOs: 8-11 and 19-26, or a homolog, fragment or variant of any of these sequences (see Table 1, column "A").

In an embodiment the Hendra virus antigenic peptide or protein is derived from a Hendra virus Fusion protein (F) according to SEQ ID NOs: 8-11.

In this context it is further preferred that the at least one coding sequence of the artificial nucleic acid sequence of the present invention encodes at least one Hendra virus peptide or protein which is derived from Hendra virus fusion protein (F), or a fragment or variant thereof, wherein the Hendra virus fusion protein (F) is selected from the Hendra virus fusion protein amino acid sequences listed in Table 1.

Therein, rows corresponding to a Hendra virus fusion protein (F) (SEQ ID NOs: 8-11) can be identified by the respective gene name (first column "Name": "F") and the database accession number of the corresponding protein (second column "Accession No."). The SEQ ID NOs corresponding to the nucleic acid sequence of the wild type nucleic acid encoding the Hendra virus fusion protein (F) or peptide is indicated in the fourth column ("B"). The further columns ("C"-"J") provide the SEQ ID NOs corresponding to modified nucleic acid sequences of the nucleic acids as described herein that encode the Hendra virus fusion protein (F) or peptide preferably having the amino acid sequence as defined by the SEQ ID NOs: 8-11 or by the database entry indicated in the second column ("Accession No.").

In an embodiment the Hendra virus antigenic peptide or protein is derived from a Hendra virus glycoprotein (G) according to SEQ ID NOs: 19-26.

In this context it is further preferred that the at least one coding sequence of the artificial nucleic acid sequence of the present invention encodes at least one Hendra virus peptide or protein which is derived from Hendra virus glycoprotein (G), or a fragment or variant thereof, wherein the Hendra virus glycoprotein (G) is selected from the Hendra virus fusion protein amino acid sequences listed in Table 1.

Therein, rows corresponding to a Hendra virus glycoprotein (G) (SEQ ID NOs: 19-26) can be identified by the respective gene name (first column "Name": "F") and the database accession number of the corresponding protein (second column "Accession No."). The SEQ ID NOs corresponding to the nucleic acid sequence of the wild type nucleic acid encoding the Hendra virus glycoprotein (G) or peptide is indicated in the fourth column ("B"). The further columns ("C"-"J") provide the SEQ ID NOs corresponding to modified nucleic acid sequences of the nucleic acids as described herein that encode the Hendra virus glycoprotein (G) or peptide preferably having the amino acid sequence as defined by the SEQ ID NOs: 19-26 or by the database entry indicated in the second column ("Accession No.").

In a specific embodiment, Hendra virus glycoprotein (G) (SEQ ID NOs: 19-26) is N-terminally truncated to generate a soluble form of the protein (solG). The N-terminal truncation has to be adapted in a way that membrane-bound domains of the protein are removed. The membrane topology of a protein can be determined using prediction algorithms as commonly known in the art (e.g. HMMTop (Tusnády and Simon (1998) Principles Governing Amino Acid Composition of Integral Membrane Proteins: Applications to Topology Prediction." *J. Mol. Biol.* 283, 489-506) or TMHMM (Krogh et al. Predicting transmembrane protein topology with a hidden Markov model: Application to complete genomes. *Journal of Molecular Biology,* 305(3): 567-580, January 2001).

Hendra virus full length glycoprotein (G) polypeptides consist of 604 amino acids (see Table 1).

In embodiments, soluble forms of the Hendra virus G protein (solG) are generated by truncating the first 68, 69, 70, 71, 72, 73, 74, 75, 76, 77, 78, 79, or 80 amino acids of the protein according to SEQ ID NOs: 19-26. In other words, amino acids 69-604, 70-604, 71-604, 72-604, 73-604, 74-604, 75-604, 76-604, 77-604, 78-604, 79-604, 80-604, 81-604 of the proteins according to SEQ ID NOs: 19-26 are soluble forms of glycoprotein (solG).

In preferred embodiments, soluble forms of the protein (solG) are generated by truncating the first 70 amino acids of the protein according to SEQ ID NOs: 19-26. In other words, amino acids 71-604 of the proteins according to SEQ ID NOs: 19-26 are soluble forms of glycoprotein (solG).

In another specific embodiment, soluble forms of the protein (solG) are generated by truncating the first 73 amino acids of the protein according to SEQ ID NOs: 19-26. In other words, amino acids 74-604 of the proteins according to SEQ ID NOs: 19-26 are soluble forms of glycoprotein (solG).

In this context it is preferred that the at least one coding sequence of the artificial nucleic acid sequence of the present invention encodes at least one Hendra virus antigenic peptide or protein which is derived from Hendra virus soluble glycoprotein (solG) as defined above, or a fragment or variant thereof. Suitable Hendra virus soluble glycoprotein (solG) proteins (and respective nucleic acid coding sequences) are provided in Table 1B.

To facilitate secretion of the truncated solG protein, elements that promote secretion may be N-terminally fused to the (N-terminally truncated) Hendra virus solG proteins as specified above. In specific embodiments, heterologous secretory signal peptides may be used, preferably selected from the list comprising SEQ ID NOs: 258-282, 310-316 wherein IgE leader (SEQ ID NO: 264) and HA signal peptide (SEQ ID NO: 282) are particularly preferred. Further details about secretory signal peptides are provided in the paragraph "Secretory signal peptides" of the present application and in Table 3.

Accordingly, in this context it is preferred that the at least one coding sequence of the artificial nucleic acid sequence of the present invention encodes at least one Hendra virus antigenic peptide or protein which is derived from a truncated Hendra virus solG as defined above, or a fragment or variant thereof, additionally comprising an N-terminal heterologous secretory signal peptide as defined above, or a fragment or variant thereof. Suitable Hendra virus soluble glycoprotein (solG) proteins comprising an N-terminal heterologous secretory signal peptide (and respective nucleic acid coding sequences) are provided in Table 1B.

In a specific embodiment, Hendra virus fusion protein (F) (SEQ ID NOs: 8-11) is N-terminally truncated to remove the endogenous secretory signal peptide to generate truncated forms of Hendra virus fusion protein (F). The N-terminal truncation has to be adapted in a way that secretory signal peptide of the protein are removed. Secretory signal peptides of a protein can be determined using prediction algorithms as commonly known in the art (e.g. SignalP (SignalP 4.0: discriminating signal peptides from transmembrane regions Thomas Nordahl Petersen, Søren Brunak, Gunnar von Heijne & Henrik Nielsen, Nature Methods, 8:785-786, 2011).

Hendra virus full length Fusion (F) proteins commonly consist of 546 amino acids (see Table 1).

In embodiments, Hendra F proteins lacking the endogenous signal peptide (SS) are generated by truncating the first 25 amino acids of the protein according to SEQ ID NOs: 8-11. In other words, amino acids 26-546 of the proteins according to SEQ ID NOs: 8-11 are truncated forms of glycoprotein (FdelSS).

In embodiments, Hendra F proteins lacking the endogenous signal peptide (SS) are generated by truncating the first 26 amino acids of the protein according to SEQ ID NOs: 8-11. In other words, amino acids 27-546 of the proteins according to SEQ ID NOs: 8-11 are truncated forms of F protein (FdelSS).

In this context it is preferred that the at least one coding sequence of the artificial nucleic acid sequence of the present invention encodes at least one Hendra virus antigenic peptide or protein which is derived from Hendra virus FdelSS as defined above, or a fragment or variant thereof. Suitable Hendra virus truncated forms of Hendra F protein (FdelSS) (and respective nucleic acid coding sequences) are provided in Table 1B.

To facilitate secretion or improve secretion of the truncated F proteins (FdelSS), elements that promote secretion may be N-terminally fused to the (N-terminally truncated) Hendra virus FdelSS proteins as specified above. In specific embodiments, heterologous secretory signal peptides may be used, preferably selected from the list comprising SEQ ID NOs: 258-282, 310-316, wherein IgE leader (SEQ ID NO: 264) and HA signal peptide (SEQ ID NO: 282) are particularly preferred. Further details about secretory signal peptides are provided in the paragraph "Secretory signal peptides" of the present application and in Table 3.

Accordingly it is preferred that the at least one coding sequence of the artificial nucleic acid sequence of the present invention encodes at least one Hendra virus antigenic peptide or protein which is derived from a truncated Hendra virus FdelSS as defined above, or a fragment or variant thereof, additionally comprising an N-terminal heterologous secretory signal peptide as defined above, or a fragment or variant thereof. Suitable Hendra virus FdelSS proteins comprising an N-terminal heterologous secretory signal peptide (and respective nucleic acid coding sequences) are provided in Table 1B.

In this context, it is particularly preferred that the at least one coding sequence of the artificial nucleic acid sequence of the present invention encodes a Hendra virus FdelSS proteins as provided in Table 1B. Particularly preferred are Hendra virus FdelSS proteins additionally comprising an N-terminal heterologous secretory signal peptide (ICE-leader or HA signal peptide), preferably selected from the antigens listed in Table 1B. In addition, Table 1B provides suitable nucleic acid sequences encoding FdelSS and FdelSS proteins additionally comprising an N-terminal heterologous secretory signal peptides.

In Table 1B provided herein, each row corresponds to a Hendra virus antigenic peptide or protein as identified by the respective construct name (first column "Name"). The second column ("A", "Protein") in Table 1B indicates the SEQ ID NOs corresponding to the respective amino acid sequence as provided herein. The SEQ ID NOs corresponding to the nucleic acid sequence of the wild type nucleic acid sequence encoding the indicated Hendra virus antigenic protein or peptide is indicated in the fourth column ("B", "CDS wt"). The following columns ("C"-"J") provides the SEQ ID NOs corresponding to modified nucleic acid sequences (opt1, opt2, opt3, opt4, opt5, opt6, opt7) of the nucleic acid sequences as described herein that encode the Hendra virus protein or peptide preferably having the amino acid sequence as defined by the SEQ ID NOs indicated in the second column ("A"). Additional information regarding each of the sequences provided in Table 1B may also be derived from the sequence listing, in particular from the details provided therein under identifier <223>.

TABLE 1B

List of truncated Hendra virus antigens and Signal-peptide fusion proteins:

| Name | A Protein | B CDS wt | C CDS opt1 | D CDS opt2 | E CDS opt3 | F CDS opt4 | G CDS opt5 | H CDS opt6 | J CDS opt7 |
|---|---|---|---|---|---|---|---|---|---|
| F(27-546) (FdelSS) | 580 | 606 | 632 | 658 | 684 | 710 | 736 | 762 | 788 |
| F(27-546) (FdelSS) | 581 | 607 | 633 | 659 | 685 | 711 | 737 | 763 | 789 |
| F(26-546) (FdelSS) | 582 | 608 | 634 | 660 | 686 | 712 | 738 | 764 | 790 |
| F(27-546) (FdelSS) | 583 | 609 | 635 | 661 | 687 | 713 | 739 | 765 | 791 |
| HsIgE(1-18)_F(27-546) | 814 | 840 | 866 | 892 | 918 | 944 | 970 | 996 | 1022 |
| HsIgE(1-18)_F(27-546) | 815 | 841 | 867 | 893 | 919 | 945 | 971 | 997 | 1023 |
| HsIgE(1-18)_F(26-546) | 816 | 842 | 868 | 894 | 920 | 946 | 972 | 998 | 1024 |
| HsIgE(1-18)_F(27-546) | 817 | 843 | 869 | 895 | 921 | 947 | 973 | 999 | 1025 |
| H1N1-HA(1-17)_F(27-546) | 1048 | 1074 | 1100 | 1126 | 1152 | 1178 | 1204 | 1230 | 1256 |
| H1N1-HA(1-17)_F(27-546) | 1049 | 1075 | 1101 | 1127 | 1153 | 1179 | 1205 | 1231 | 1257 |
| H1N1-HA(1-17)_F(26-546) | 1050 | 1076 | 1102 | 1128 | 1154 | 1180 | 1206 | 1232 | 1258 |
| H1N1-HA(1-17)_F(27-546) | 1051 | 1077 | 1103 | 1129 | 1155 | 1181 | 1207 | 1233 | 1259 |
| G(70-604) (solG) | 591 | 617 | 643 | 669 | 695 | 721 | 747 | 773 | 799 |
| G(70-604) (solG) | 592 | 618 | 644 | 670 | 696 | 722 | 748 | 774 | 800 |
| G(70-604) (solG) | 593 | 619 | 645 | 671 | 697 | 723 | 749 | 775 | 801 |
| G(70-604) (solG) | 594 | 620 | 646 | 672 | 698 | 724 | 750 | 776 | 802 |
| G(70-604) (solG) | 595 | 621 | 647 | 673 | 699 | 725 | 751 | 777 | 803 |
| G(70-604) (solG) | 596 | 622 | 648 | 674 | 700 | 726 | 752 | 778 | 804 |
| G(70-604) (solG) | 597 | 623 | 649 | 675 | 701 | 727 | 753 | 779 | 805 |
| G(70-604) (solG) | 598 | 624 | 650 | 676 | 702 | 728 | 754 | 780 | 806 |
| HsIgE(1-18)_G(70-604) | 825 | 851 | 877 | 903 | 929 | 955 | 981 | 1007 | 1033 |
| HsIgE(1-18)_G(70-604) | 826 | 852 | 878 | 904 | 930 | 956 | 982 | 1008 | 1034 |
| HsIgE(1-18)_G(70-604) | 827 | 853 | 879 | 905 | 931 | 957 | 983 | 1009 | 1035 |
| HsIgE(1-18)_G(70-604) | 828 | 854 | 880 | 906 | 932 | 958 | 984 | 1010 | 1036 |
| HsIgE(1-18)_G(70-604) | 829 | 855 | 881 | 907 | 933 | 959 | 985 | 1011 | 1037 |
| HsIgE(1-18)_G(70-604) | 830 | 856 | 882 | 908 | 934 | 960 | 986 | 1012 | 1038 |
| HsIgE(1-18)_G(70-604) | 831 | 857 | 883 | 909 | 935 | 961 | 987 | 1013 | 1039 |
| HsIgE(1-18)_G(70-604) | 832 | 858 | 884 | 910 | 936 | 962 | 988 | 1014 | 1040 |
| H1N1-HA(1-17)_G(70-604) | 1059 | 1085 | 1111 | 1137 | 1163 | 1189 | 1215 | 1241 | 1267 |
| H1N1-HA(1-17)_G(70-604) | 1060 | 1086 | 1112 | 1138 | 1164 | 1190 | 1216 | 1242 | 1268 |
| H1N1-HA(1-17)_G(70-604) | 1061 | 1087 | 1113 | 1139 | 1165 | 1191 | 1217 | 1243 | 1269 |
| H1N1-HA(1-17)_G(70-604) | 1062 | 1088 | 1114 | 1140 | 1166 | 1192 | 1218 | 1244 | 1270 |
| H1N1-HA(1-17)_G(70-604) | 1063 | 1089 | 1115 | 1141 | 1167 | 1193 | 1219 | 1245 | 1271 |
| H1N1-HA(1-17)_G(70-604) | 1064 | 1090 | 1116 | 1142 | 1168 | 1194 | 1220 | 1246 | 1272 |
| H1N1-HA(1-17)_G(70-604) | 1065 | 1091 | 1117 | 1143 | 1169 | 1195 | 1221 | 1247 | 1273 |
| H1N1-HA(1-17)_G(70-604) | 1066 | 1092 | 1118 | 1144 | 1170 | 1196 | 1222 | 1248 | 1274 |

According to preferred embodiments, the inventive artificial nucleic acid comprises or consists of at least one coding sequence encoding at least one Hendra virus antigenic peptide or peptide as provided herein, wherein the at least one Hendra virus antigenic peptide or protein comprises at least one amino acid sequence being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 580-583, 591-598, 814-817, 825-832, 1048-1051, 1059-1066, or a fragment or variant or orthologue or paralogue of any of these.

In other embodiments, the inventive artificial nucleic acid comprises or consists of at least one coding sequence encoding at least one antigenic peptide or protein derived from a Hendra virus RNA-directed RNA polymerase (L), Hendra virus fusion protein (F), Hendra virus non-structural protein (V), Hendra virus glycoprotein (G), Hendra virus nucleoprotein (N), Hendra virus matrix protein (M), Hendra virus phosphoprotein (P), Hendra virus protein C, and Hendra virus protein W or a fragment or variant of any of these.

In another embodiment, the inventive artificial nucleic acid comprises or consists of at least one coding sequence encoding at least one antigenic peptide or protein derived from Hendra virus RNA-directed RNA polymerase (L), or a fragment or variant thereof. In another embodiment, the inventive artificial nucleic acid comprises or consists of at least one coding sequence encoding at least one antigenic peptide or protein derived from Hendra virus non-structural protein (V), or a fragment or variant thereof. In another embodiment, the inventive artificial nucleic acid comprises or consists of at least one coding sequence encoding at least one antigenic peptide or protein derived from Hendra virus nucleoprotein (N), or a fragment or variant thereof. In another embodiment, the inventive artificial nucleic acid comprises or consists of at least one coding sequence encoding at least one antigenic peptide or protein derived from Hendra virus matrix protein (M), or a fragment or variant thereof. In another embodiment, the inventive artificial nucleic acid comprises or consists of at least one coding sequence encoding at least one antigenic peptide or protein derived from Hendra virus phosphoprotein (P), or a fragment or variant thereof. In another embodiment, the inventive artificial nucleic acid comprises or consists of at least one coding sequence encoding at least one antigenic peptide or protein derived from Hendra virus protein C, or a fragment or variant thereof. In another embodiment, the inventive artificial nucleic acid comprises or consists of at least one coding sequence encoding at least one antigenic peptide or protein derived from Hendra virus protein W, or a fragment or variant thereof.

Nipah Virus Peptides or Proteins:

The term "Nipah virus protein" or "Nipah virus peptide" as used in the present invention may relate to an amino acid sequence corresponding to any Nipah virus RNA-directed RNA polymerase (L), Nipah virus fusion protein (F), Nipah virus non-structural protein (V), Nipah virus glycoprotein (G), Nipah virus nucleoprotein (N), Nipah virus matrix protein (M), Nipah virus phosphoprotein (P), Nipah virus protein C, and Nipah virus protein W.

Any Nipah virus peptide or protein provided herein, or any a fragment or variant thereof, can cause an immune response when administered to a subject. Therefore, all Nipah virus proteins or peptides provided herein can be considered as antigens in the context of the present invention.

In some embodiments described herein, the at least one Nipah virus antigenic peptide or protein encoded by the at least one coding sequence of the artificial nucleic acid may consist of an individual Nipah virus protein, the amino acid sequence of which does typically not comprise an N-terminal Methionine residue. It is thus understood that the phrase "artificial nucleic acid comprising at least one coding sequence encoding at least one antigenic peptide or protein derived from a Nipah virus . . . " relates to a protein or peptide comprising the amino acid sequence of said Nipah virus protein and—if the amino acid sequence of the respective Nipah virus protein does not comprise such an N-terminal Methionine residue—an introduced N-terminal Methionine residue.

In the context of the present invention a fragment of a protein or a variant thereof encoded by the at least one coding sequence of the artificial nucleic acid according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of the respective naturally occurring full-length Nipah virus protein or a variant thereof, preferably as disclosed in Table 2 or Table 2B.

In a preferred embodiment, the at least one coding sequence of the artificial nucleic acid sequence according to the invention preferably encodes Nipah virus proteins selected from the proteins provided in Table 2 or Table 2B, or a fragment or variant thereof. Any Nipah virus protein provided in Table 2 or Table 2B, or any a fragment or variant thereof, can cause an immune response when administered to an individual. Therefore, all Nipah virus proteins provided in Table 2 or Table 2B can be considered as preferred Nipah virus antigens in the context of the present invention.

It is further preferred that the at least one coding sequence of the artificial nucleic acid sequence of the present invention encodes a Nipah virus protein or peptide, or a fragment or variant thereof, wherein the Nipah virus protein or peptide is an antigen selected from the antigens listed in Table 2. Therein, each row corresponds to a Nipah virus antigenic peptide or protein as identified by the respective gene name (first column "Name") and the NCBI database accession number of the corresponding protein (second column "Accession No."). The third column ("A", "protein") in Table 2 indicates the SEQ ID NOs corresponding to the respective amino acid sequence as provided herein. The SEQ ID NOs corresponding to the nucleic acid sequence of the wild type nucleic acid sequence encoding the Nipah virus antigenic protein or peptide is indicated in the fourth column ("B", "CDS wt"). The following columns ("C"-"J") provides the SEQ ID NOs corresponding to modified nucleic acid sequences (opt1, opt2, opt3, opt4, opt5, opt6, opt7) of the nucleic acid sequences as described herein that encode the Nipah virus protein or peptide preferably having the amino acid sequence as defined by the SEQ ID NOs indicated in the third column ("A") or by the database entry indicated in the second column ("Accession No."). Additional information regarding each of the sequences provided in Table 2 may also be derived from the sequence listing, in particular from the details provided therein under identifier <223>.

TABLE 2

List of Nipah virus antigens:

| Name | Accession No. | A Protein | B CDS wt | C opt1 | D opt2 | E opt3 | F opt4 | G opt5 | H opt6 | J opt7 |
|---|---|---|---|---|---|---|---|---|---|---|
| F | AAK50553.1 | 1 | 27 | 53 | 79 | 105 | 131 | 157 | 183 | 209 |
| F | AEZ01388.1 | 2 | 28 | 54 | 80 | 106 | 132 | 158 | 184 | 210 |
| F | AAY43915.1 | 3 | 29 | 55 | 81 | 107 | 133 | 159 | 185 | 211 |
| F | CAF25496.1 | 4 | 30 | 56 | 82 | 108 | 134 | 160 | 186 | 212 |
| F | AAM13405.1 | 5 | 31 | 57 | 83 | 109 | 135 | 161 | 187 | 213 |
| F | CBM41033.1 | 6 | 32 | 58 | 84 | 110 | 136 | 162 | 188 | 214 |
| F | AEZ01396.1 | 7 | 33 | 59 | 85 | 111 | 137 | 163 | 189 | 215 |
| G | AAK50554.1 | 12 | 38 | 64 | 90 | 116 | 142 | 168 | 194 | 220 |
| G | AEZ01389.1 | 13 | 39 | 65 | 91 | 117 | 143 | 169 | 195 | 221 |
| G | ACT32615.1 | 14 | 40 | 66 | 92 | 118 | 144 | 170 | 196 | 222 |
| G | CAF25497.1 | 15 | 41 | 67 | 93 | 119 | 145 | 171 | 197 | 223 |
| G | CBM41034.1 | 16 | 42 | 68 | 94 | 120 | 146 | 172 | 198 | 224 |
| G | AAX51853.1 | 17 | 43 | 69 | 95 | 121 | 147 | 173 | 199 | 225 |
| G | AEZ01397.1 | 18 | 44 | 70 | 96 | 122 | 148 | 174 | 200 | 226 |

According to preferred embodiments, the inventive artificial nucleic acid comprises or consists of at least one coding sequence encoding at least one Nipah virus antigenic peptide or peptide as described herein, wherein the at least one Nipah virus antigenic peptide or protein comprises at least one amino acid sequence being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-7, 12-18, 573-579, 584-590, 807-813, 818-824, 1041-1047, 1052-1058, 1513-1515 or a fragment or variant or orthologue or paralogue of any of these.

According to a preferred embodiment, the inventive artificial nucleic acid comprises or consists of at least one coding sequence encoding at least one Nipah virus antigenic peptide or peptide as described herein, wherein the at least one Nipah virus antigenic peptide or protein comprises an amino acid sequence according to any one of SEQ ID NOs: 1-7 and 12-18, or a homolog, fragment or variant of any of these sequences (see Table 2, column "A").

In an embodiment the Nipah virus antigenic peptide or protein is derived from a Nipah virus Fusion protein (F) according to SEQ ID NOs: 1-7.

In this context it is further preferred that the at least one coding sequence of the artificial nucleic acid sequence of the present invention encodes at least one Nipah virus peptide or protein which is derived from Nipah virus fusion protein (F), or a fragment or variant thereof, wherein the Nipah virus fusion protein (F) is selected from the Nipah virus fusion protein amino acid sequences listed in Table 2.

Therein, rows corresponding to a Nipah virus fusion protein (F) (SEQ ID NOs: 1-7) can be identified by the respective gene name (first column "Name": "F") and the database accession number of the corresponding protein (second column "Accession No."). The SEQ ID NOs: corresponding to the nucleic acid sequence of the wild type nucleic acid encoding the Nipah virus fusion protein (F) or peptide is indicated in the fourth column ("B"). The further columns ("C"-"J") provide the SEQ ID NOs corresponding to modified nucleic acid sequences of the nucleic acids as described herein that encode the Nipah virus fusion protein (F) or peptide preferably having the amino acid sequence as defined by the SEQ ID NOs: 1-7 or by the database entry indicated in the second column ("Accession No.").

In an embodiment the Nipah virus antigenic peptide or protein is derived from a Nipah virus glycoprotein (G) according to SEQ ID NOs: 12-18.

In this context it is further preferred that the at least one coding sequence of the artificial nucleic acid sequence of the present invention encodes at least one Nipah virus peptide or protein which is derived from Nipah virus glycoprotein (G), or a fragment or variant thereof, wherein the Nipah virus glycoprotein (G) is selected from the Nipah virus fusion protein amino acid sequences listed in Table 2.

Therein, rows corresponding to a Nipah virus glycoprotein (G) (SEQ ID NOs: 12-18) can be identified by the respective gene name (first column "Name": "F") and the database accession number of the corresponding protein (second column "Accession No."). The SEQ ID NOs: corresponding to the nucleic acid sequence of the wild type nucleic acid encoding the Nipah virus glycoprotein (G) or peptide is indicated in the fourth column ("B"). The further columns ("C"-"J") provide the SEQ ID NOs corresponding to modified nucleic acid sequences of the nucleic acids as described herein that encode the Nipah virus glycoprotein (G) or peptide preferably having the amino acid sequence as defined by the SEQ ID NOs: 12-18 or by the database entry indicated in the second column ("Accession No.").

In a specific embodiment, Nipah virus glycoprotein (G) (SEQ ID NOs: 12-18) is N-terminally truncated to generate a soluble form of the protein (solG). The N-terminal truncation has to be adapted in a way that membrane-bound domains of the protein are removed. The membrane topology of a protein can be determined using prediction algorithms as commonly known in the art.

Nipah virus glycoprotein (G) polypeptides commonly consist of 602 amino acids (see Table 2).

In embodiments, soluble forms of the Nipah virus G protein (solG) are generated by truncating the first 68, 69, 70, 71, 72, 73, 74, 75, 76, 77, 78, 79, or 80 amino acids of the protein according to SEQ ID NOs: 12-18. In other words, amino acids 69-602, 70-602, 71-602, 72-602, 73-602, 74-602, 75-602, 76-602, 77-602, 78-602, 79-602, 80-602, 81-602 of the proteins according to SEQ ID NOs: 12-18 are soluble forms of glycoprotein (solG).

In a preferred embodiments, soluble forms of the Nipah virus protein (solG) are generated by truncating the first 70 amino acids of the protein according to SEQ ID NOs: 12-18. In other words, amino acids 71-602 of the proteins according to SEQ ID NOs: 12-18 are soluble forms of glycoprotein (solG).

In another specific embodiment, soluble forms of the Nipah virus protein (solG) are generated by truncating the first 72 amino acids of the protein according to SEQ ID NOs 12-18. In other words, amino acids 73-602 of the proteins according to SEQ ID NOs 12-18 are soluble forms of glycoprotein (solG).

In this context it is preferred that the at least one coding sequence of the artificial nucleic acid sequence of the present invention encodes at least one Nipah virus antigenic peptide or protein which is derived from Nipah virus soluble glycoprotein (solG) as defined above, or a fragment or variant thereof. Suitable Nipah virus soluble glycoprotein (solG) proteins (and respective nucleic acid coding sequences) are provided in Table 2B.

To facilitate secretion of the truncated protein, elements that promote secretion may be N-terminally fused to the (N-terminally truncated) Nipah virus solG proteins. In specific embodiments, secretory signal peptides may be used, preferably selected from the list comprising SEQ ID NOs: 258-282, 310-316, wherein IgE leader (SEQ ID NO: 264) and HA signal peptide (SEQ ID NO: 282) are particularly preferred. Further details about secretory signal peptides are provided in the paragraph "Secretory signal peptides" of the present application and in Table 3.

Accordingly, in this context it is preferred that the at least one coding sequence of the artificial nucleic acid sequence of the present invention encodes at least one Hendra virus antigenic peptide or protein which is derived from a truncated Nipah virus solG as defined above, or a fragment or variant thereof, additionally comprising an N-terminal heterologous secretory signal peptide as defined above, or a fragment or variant thereof. Suitable Nipah virus soluble glycoprotein (solG) proteins comprising an N-terminal heterologous secretory signal peptide (and respective nucleic acid coding sequences) are provided in Table 2B.

In a specific embodiment, Nipah virus fusion protein (F) (SEQ ID NOs: 1-7) is N-terminally truncated to remove the endogenous secretory signal peptide to generate truncated forms of Nipah virus fusion protein (F). The N-terminal truncation has to be adapted in a way that secretory signal peptide of the protein are removed. Secretory signal peptides of a protein can be determined using prediction algorithms as commonly known in the art (e.g. SignalP (SignalP 4.0: discriminating signal peptides from transmembrane regions Thomas Nordahl Petersen, Søren Brunak, Gunnar von Heijne & Henrik Nielsen, Nature Methods, 8:785-786, 2011).

Nipah virus full length Fusion (F) proteins commonly consist of 546 amino acids (see Table 2).

In embodiments, Nipah F proteins lacking the endogenous signal peptide (SS) are generated by truncating the first 25 amino acids of the protein according to SEQ ID NOs: 1-7. In other words, amino acids 26-546 of the proteins according to SEQ ID NOs: 1-7 are truncated forms of glycoprotein (FdelSS).

In embodiments, Nipah F proteins lacking the endogenous signal peptide (SS) are generated by truncating the first 26 amino acids of the protein according to SEQ ID NOs: 1-7. In other words, amino acids 27-546 of the proteins according to SEQ ID NOs: 1-7 are truncated forms of F protein (FdelSS).

In this context it is preferred that the at least one coding sequence of the artificial nucleic acid sequence of the present invention encodes at least one Nipah virus antigenic peptide or protein which is derived from Nipah virus FdelSS as defined above, or a fragment or variant thereof. Suitable truncated forms of Nipah F protein (FdelSS) (and respective nucleic acid coding sequences) are provided in Table 2B.

To facilitate secretion or improve secretion of the truncated Nipah F proteins (FdelSS), elements that promote secretion may be N-terminally fused to the (N-terminally truncated) Nipah virus FdelSS proteins as specified above. In specific embodiments, heterologous secretory signal peptides may be used, preferably selected from the list comprising SEQ ID NOs: 258-282, 310-316, wherein IgE leader (SEQ ID NO: 264) and HA signal peptide (SEQ ID NO: 282) are particularly preferred. Further details about secretory signal peptides are provided in the paragraph "Secretory signal peptides" of the present application and in Table 3.

Accordingly it is preferred that the at least one coding sequence of the artificial nucleic acid sequence of the present invention encodes at least one antigenic peptide or protein which is derived from a truncated Nipah virus FdelSS as defined above, or a fragment or variant thereof, additionally comprising an N-terminal heterologous secretory signal peptide as defined above, or a fragment or variant thereof. Suitable Nipah virus FdelSS proteins comprising an N-terminal heterologous secretory signal peptide (and respective nucleic acid coding sequences) are provided in Table 2B.

In this context, it is particularly preferred that the at least one coding sequence of the artificial nucleic acid sequence of the present invention encodes a Nipah virus FdelSS proteins as provided in Table 2B. Particularly preferred are Nipah virus FdelSS proteins additionally comprising an N-terminal heterologous secretory signal peptide (IGE-leader or HA signal peptide), preferably selected from the antigens listed in Table 2B. In addition, Table 2B provides suitable nucleic acid sequences encoding FdelSS and Fde-lSS proteins additionally comprising an N-terminal heterologous secretory signal peptides.

In Table 2B provided herein, each row corresponds to a Nipah virus antigenic peptide or protein as identified by the respective construct name (first column "Name"). The second column ("A", "Protein") in Table 2B indicates the SEQ ID NOs corresponding to the respective amino acid sequence as provided herein. The SEQ ID NOs corresponding to the nucleic acid sequence of the wild type nucleic acid sequence encoding the indicated Nipah virus antigenic protein or peptide is indicated in the fourth column ("B", "CDS wt"). The following columns ("C"-"J") provides the SEQ ID NOs corresponding to modified nucleic acid sequences (opt1, opt2, opt3, opt4, opt5, opt6, opt7) of the nucleic acid sequences as described herein that encode the Nipah virus protein or peptide preferably having the amino acid sequence as defined by the SEQ ID NOs indicated in the second column ("A"). Additional information regarding each of the sequences provided in Table 2B may also be derived from the sequence listing, in particular from the details provided therein under identifier <223>.

TABLE 2B

List of truncated Nipah virus antigens and Signal-peptide fusion proteins:

| Name | A Protein | B CDS wt | C CDS opt1 | D CDS opt2 | E CDS opt3 | F CDS opt4 | G CDS opt5 | H CDS opt6 | J CDS opt7 |
|---|---|---|---|---|---|---|---|---|---|
| F(27-546) (FdelSS) | 573 | 599 | 625 | 651 | 677 | 703 | 729 | 755 | 781 |
| F(27-546) (FdelSS) | 574 | 600 | 626 | 652 | 678 | 704 | 730 | 756 | 782 |
| F(27-546) (FdelSS) | 575 | 601 | 627 | 653 | 679 | 705 | 731 | 757 | 783 |
| F(27-546) (FdelSS) | 576 | 602 | 628 | 654 | 680 | 706 | 732 | 758 | 784 |
| F(27-546) (FdelSS) | 577 | 603 | 629 | 655 | 681 | 707 | 733 | 759 | 785 |
| F(27-546) (FdelSS) | 578 | 604 | 630 | 656 | 682 | 708 | 734 | 760 | 786 |
| F(27-546) (FdelSS) | 579 | 605 | 631 | 657 | 683 | 709 | 735 | 761 | 787 |
| HsIgE(1-18)_F(27-546) | 807 | 833 | 859 | 885 | 911 | 937 | 963 | 989 | 1015 |
| HsIgE(1-18)_F(27-546) | 808 | 834 | 860 | 886 | 912 | 938 | 964 | 990 | 1016 |
| HsIgE(1-18)_F(27-546) | 809 | 835 | 861 | 887 | 913 | 939 | 965 | 991 | 1017 |
| HsIgE(1-18)_F(27-546) | 810 | 836 | 862 | 888 | 914 | 940 | 966 | 992 | 1018 |
| HsIgE(1-18)_F(27-546) | 811 | 837 | 863 | 889 | 915 | 941 | 967 | 993 | 1019 |
| HsIgE(1-18)_F(27-546) | 812 | 838 | 864 | 890 | 916 | 942 | 968 | 994 | 1020 |
| HsIgE(1-18)_F(27-546) | 813 | 839 | 865 | 891 | 917 | 943 | 969 | 995 | 1021 |
| H1N1-HA(1-17)_F(27-546) | 1041 | 1067 | 1093 | 1119 | 1145 | 1171 | 1197 | 1223 | 1249 |
| H1N1-HA(1-17)_F(27-546) | 1042 | 1068 | 1094 | 1120 | 1146 | 1172 | 1198 | 1224 | 1250 |
| H1N1-HA(1-17)_F(27-546) | 1043 | 1069 | 1095 | 1121 | 1147 | 1173 | 1199 | 1225 | 1251 |
| H1N1-HA(1-17)_F(27-546) | 1044 | 1070 | 1096 | 1122 | 1148 | 1174 | 1200 | 1226 | 1252 |
| H1N1-HA(1-17)_F(27-546) | 1045 | 1071 | 1097 | 1123 | 1149 | 1175 | 1201 | 1227 | 1253 |
| H1N1-HA(1-17)_F(27-546) | 1046 | 1072 | 1098 | 1124 | 1150 | 1176 | 1202 | 1228 | 1254 |
| H1N1-HA(1-17)_F(27-546) | 1047 | 1073 | 1099 | 1125 | 1151 | 1177 | 1203 | 1229 | 1255 |
| G(70-602) (solG) | 584 | 610 | 636 | 662 | 688 | 714 | 740 | 766 | 792 |
| G(70-602) (solG) | 585 | 611 | 637 | 663 | 689 | 715 | 741 | 767 | 793 |
| G(70-602) (solG) | 586 | 612 | 638 | 664 | 690 | 716 | 742 | 768 | 794 |
| G(70-602) (solG) | 587 | 613 | 639 | 665 | 691 | 717 | 743 | 769 | 795 |
| G(70-602) (solG) | 588 | 614 | 640 | 666 | 692 | 718 | 744 | 770 | 796 |
| G(70-602) (solG) | 589 | 615 | 641 | 667 | 693 | 719 | 745 | 771 | 797 |
| G(70-602) (solG) | 590 | 616 | 642 | 668 | 694 | 720 | 746 | 772 | 798 |
| HsIgE(1-18)_G(70-602) | 818 | 844 | 870 | 896 | 922 | 948 | 974 | 1000 | 1026 |
| HsIgE(1-18)_G(70-602) | 819 | 845 | 871 | 897 | 923 | 949 | 975 | 1001 | 1027 |
| HsIgE(1-18)_G(70-602) | 820 | 846 | 872 | 898 | 924 | 950 | 976 | 1002 | 1028 |
| HsIgE(1-18)_G(70-602) | 821 | 847 | 873 | 899 | 925 | 951 | 977 | 1003 | 1029 |
| HsIgE(1-18)_G(70-602) | 822 | 848 | 874 | 900 | 926 | 952 | 978 | 1004 | 1030 |
| HsIgE(1-18)_G(70-602) | 823 | 849 | 875 | 901 | 927 | 953 | 979 | 1005 | 1031 |
| HsIgE(1-18)_G(70-602) | 824 | 850 | 876 | 902 | 928 | 954 | 980 | 1006 | 1032 |
| H1N1-HA(1-17)_G(70-602) | 1052 | 1078 | 1104 | 1130 | 1156 | 1182 | 1208 | 1234 | 1260 |
| H1N1-HA(1-17)_G(70-602) | 1053 | 1079 | 1105 | 1131 | 1157 | 1183 | 1209 | 1235 | 1261 |
| H1N1-HA(1-17)_G(70-602) | 1054 | 1080 | 1106 | 1132 | 1158 | 1184 | 1210 | 1236 | 1262 |
| H1N1-HA(1-17)_G(70-602) | 1055 | 1081 | 1107 | 1133 | 1159 | 1185 | 1211 | 1237 | 1263 |
| H1N1-HA(1-17)_G(70-602) | 1056 | 1082 | 1108 | 1134 | 1160 | 1186 | 1212 | 1238 | 1264 |
| H1N1-HA(1-17)_G(70-602) | 1057 | 1083 | 1109 | 1135 | 1161 | 1187 | 1213 | 1239 | 1265 |
| H1N1-HA(1-17)_G(70-602) | 1058 | 1084 | 1110 | 1136 | 1162 | 1188 | 1214 | 1240 | 1266 |
| HsSPARC(1-17)_F(27-546) | 1513 | 1516 | 1519 | 1522 | 1525 | 1528 | 1531 | 1534 | 1537 |
| HsCTRB2(1-18)_F(27-546) | 1514 | 1517 | 1520 | 1523 | 1526 | 1529 | 1532 | 1535 | 1538 |
| Nipah henipavirus_AAK50553_F(1-26)_F(27-546) | 1515 | 1518 | 1521 | 1524 | 1527 | 1530 | 1533 | 1536 | 1539 |

According to preferred embodiments, the inventive artificial nucleic acid comprises or consists of at least one coding sequence encoding at least one Nipah virus antigenic peptide or peptide as provided herein, wherein the at least one Nipah virus antigenic peptide or protein comprises at least one amino acid sequence being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 573-579, 584-590, 807-813, 818-824, 1041-1047, 1052-1058, 1513-1515 or a fragment or variant or orthologue or paralogue of any of these.

In other embodiments, the inventive artificial nucleic acid comprises or consists of at least one coding sequence encoding at least one antigenic peptide or protein derived from a Nipah virus RNA-directed RNA polymerase (L), Nipah virus fusion protein (F), Nipah virus non-structural protein (V), Nipah virus glycoprotein (G), Nipah virus nucleoprotein (N), Nipah virus matrix protein (M), Nipah virus phosphoprotein (P), Nipah virus protein C, and Nipah virus protein W or a fragment or variant of any of these.

In another embodiment, the inventive artificial nucleic acid comprises or consists of at least one coding sequence encoding at least one antigenic peptide or protein derived from Nipah virus RNA-directed RNA polymerase (L), or a fragment or variant thereof. In another embodiment, the inventive artificial nucleic acid comprises or consists of at least one coding sequence encoding at least one antigenic peptide or protein derived from Nipah virus non-structural protein (V), or a fragment or variant thereof. In another embodiment, the inventive artificial nucleic acid comprises or consists of at least one coding sequence encoding at least one antigenic peptide or protein derived from Nipah virus nucleoprotein (N), or a fragment or variant thereof. In another embodiment, the inventive artificial nucleic acid comprises or consists of at least one coding sequence encoding at least one antigenic peptide or protein derived from Nipah virus matrix protein (M), or a fragment or variant thereof. In another preferred embodiment, the inventive artificial nucleic acid comprises or consists of at least one coding sequence encoding at least one antigenic peptide or protein derived from Nipah virus phosphoprotein (P), or a fragment or variant thereof. In another embodiment, the inventive artificial nucleic acid comprises or consists of at least one coding sequence encoding at least one antigenic peptide or protein derived from Nipah virus protein C, or a fragment or variant thereof. In another embodiment, the inventive artificial nucleic acid comprises or consists of at least one coding sequence encoding at least one antigenic peptide or protein derived from Nipah virus protein W, or a fragment or variant thereof.

Additional Peptide or Protein Elements:

According to another particularly preferred embodiment, the artificial nucleic acid sequence, particularly the RNA sequence according to the invention may additionally encode a further, preferably heterologous peptide or protein elements, that e.g., promote secretion of the protein (secretory signal peptides), promote anchoring of the encoded antigen in the plasma membrane (transmembrane domains), promote virus-like particle formation (VLP forming domains). In addition, the artificial nucleic acid sequence according to the present invention may additionally encode peptide linker elements, self-cleaving peptides or helper peptides. Further, the artificial nucleic acid sequence according to the present invention may additionally encode an immunologic adjuvant sequence, and/or a dendritic cell targeting sequence.

Secretory Signal Peptides:

According another preferred embodiment, the artificial nucleic acid sequence, particularly the RNA sequence according to the invention may additionally or alternatively encode at least one secretory signal peptide. Such signal peptides are sequences, which typically exhibit a length of about 15 to 30 amino acids and are preferably located at the N-terminus of the encoded peptide, without being limited thereto. Signal peptides as defined herein preferably allow the transport of the Henipavirus and/or Hendra virus and/or Nipah virus antigenic peptide or proteins as encoded by the at least one artificial nucleic acid sequence into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulins as defined herein, signal sequences of the invariant chain of immunoglobulins or antibodies as defined herein, signal sequences of Lamp1, Tapasin, Erp57, Calretikulin, Calnexin, and further membrane associated proteins or of proteins associated with the endoplasmic reticulum (ER) or the endosomal-lysosomal compartment. Most preferably, signal sequences of MHC class I molecule HLA-A*0201 may be used according to the present invention. For example, a signal peptide derived from HLA-A is preferably used in order to promote secretion of the encoded Henipavirus and/or Hendra virus and/or Nipah virus antigen as defined herein or a fragment or variant thereof. More preferably, an HLA-A signal peptide is fused to an encoded Henipavirus and/or Hendra virus and/or Nipah virus antigen as defined herein or to a fragment or variant thereof. Particularly preferred secretory signal peptides according to the present invention are provided in the sequence listing (SEQ ID NOs: 258-282, 310-316). Further suitable secretory signal peptides may be selected from the list of amino acid sequences according to SEQ ID NOs: 1-1115 and SEQ ID NO: 1728 of the patent application WO2017/081082, or fragments or variants of these sequences, herewith incorporated by reference. Particularly preferred secretory signal peptides in the context of the invention are IgE leader (HsIgE(1-18)) (SEQ ID NO: 264) HA signal peptide (H1N1-HA(1-17)) (SEQ ID NO: 282), HsSPARC (SEQ ID NO: 281), and HsCTRB2 (SEQ ID NO: 267).

On nucleic acid level, particularly RNA level, any nucleotide sequence moiety can be employed that encodes any of secretory signal peptides used in the context of the present invention. Owing to the degenerated genetic code, e.g. in the case of most peptide sequences according to SEQ ID NOs: 258-282, 310-316 more than one particular nucleic acid sequence is conceivable as encoding the respective polypeptide. While each and every such nucleic acid may generally be used in the context of the present invention, it is preferable that the nucleic acid sequence that encodes the polypeptide sequence is selected such that its sequence is optimized according to the general guidance provided in this specification.

In the context of the invention, it is particularly preferred that the secretory signal peptide as defined herein is located at the N-terminus of the at least one antigenic peptide or protein, followed by a F-protein lacking its endogenous secretory signal peptide (FdeISS) as defined above or followed by a G-protein lacking its endogenous transmembrane domain (solG) as defined above (see also Table 1B and Table 2B).

In preferred embodiments, secretory signal peptides may suitably be selected from those provided in Table 3. In Table 3, each row corresponds to a secretory signal peptide as identified by the respective name (first column "Name") and the Accession number (second column "NCBI Accession No.") The third column ("A", "Protein") in Table 3 indicates the SEQ ID NOs corresponding to the respective amino acid sequence as provided herein. The SEQ ID NOs corresponding to the nucleic acid sequence of the wild type nucleic acid sequence encoding the indicated secretory signal peptide is indicated in the fourth column ("B", "CDS wt"). The following columns ("C-J") provides the SEQ ID NOs corresponding to modified nucleic acid sequences (opt1, opt2, opt3, opt4, opt5, opt6, opt7) of the nucleic acid sequences as described herein that encode the secretory signal peptide preferably having the amino acid sequence as defined by the SEQ ID NOs indicated in the third column ("A") or by the database entry indicated in the second column ("Accession No."). Additional information regarding each of the sequences provided in Table 3 may also be derived from the sequence listing, in particular from the details provided therein under identifier <223>.

TABLE 3

List of suitable secretory signal peptides:

| Name | NCBI Accession No. | A Protein | B CDS wt | C CDS opt1 | D CDS opt2 | E CDS opt3 | F CDS opt4 | G CDS opt5 | H CDS opt6 | J CDS opt7 |
|---|---|---|---|---|---|---|---|---|---|---|
| HsHLA-A2(1-24) | AAA59606 | 258 | 317 | 349 | 381 | 413 | 445 | 477 | 509 | 541 |
| HsPLAT(1-23) | AAA61213 | 259 | 318 | 350 | 382 | 414 | 446 | 478 | 510 | 542 |
| HsPLAT(1-21) | AAA61213 | 260 | 319 | 351 | 383 | 415 | 447 | 479 | 511 | 543 |
| HsPLAT(1-22) | AAA61213 | 261 | 320 | 352 | 384 | 416 | 448 | 480 | 512 | 544 |
| HsEPO(1-27) | NP_000790 | 262 | 321 | 353 | 385 | 417 | 449 | 481 | 513 | 545 |

TABLE 3-continued

List of suitable secretory signal peptides:

| Name | NCBI Accession No. | A Protein | B CDS wt | C CDS opt1 | D CDS opt2 | E CDS opt3 | F CDS opt4 | G CDS opt5 | H CDS opt6 | J CDS opt7 |
|---|---|---|---|---|---|---|---|---|---|---|
| HsALB(1-18) | NP_000468 | 263 | 322 | 354 | 386 | 418 | 450 | 482 | 514 | 546 |
| HsIgE(1-18) | AAB59424 | 264 | 323 | 355 | 387 | 419 | 451 | 483 | 515 | 547 |
| HsCD5(1-24) | NP_055022 | 265 | 324 | 356 | 388 | 420 | 452 | 484 | 516 | 548 |
| HsIL2(1-20) | NP_000577 | 266 | 325 | 357 | 389 | 421 | 453 | 485 | 517 | 549 |
| HsCTRB2(1-18) | NP_001020371 | 267 | 326 | 358 | 390 | 422 | 454 | 486 | 518 | 550 |
| HsIgG-HC(1-19) | BAC87457 | 268 | 327 | 359 | 391 | 423 | 455 | 487 | 519 | 551 |
| HsIg-HC(1-19) | AAA52897 | 269 | 328 | 360 | 392 | 424 | 456 | 488 | 520 | 552 |
| HsIg-LC(1-19) | AAA59018 | 270 | 329 | 361 | 393 | 425 | 457 | 489 | 521 | 553 |
| GpLuc(1-17) | AAG54095 | 271 | 330 | 362 | 394 | 426 | 458 | 490 | 522 | 554 |
| MmIgkappa(1-21) | BAR42292 | 272 | 331 | 363 | 395 | 427 | 459 | 491 | 523 | 555 |
| NrChit1(1-26) | ABF74624 | 273 | 332 | 364 | 396 | 428 | 460 | 492 | 524 | 556 |
| ClLp1.1(1-21) | AAS93426 | 274 | 333 | 365 | 397 | 429 | 461 | 493 | 525 | 557 |
| NgNep1(1-24) | AB114914 | 275 | 334 | 366 | 398 | 430 | 462 | 494 | 526 | 558 |
| HsAzu1(1-19) | NP_001691 | 276 | 335 | 367 | 399 | 431 | 463 | 495 | 527 | 559 |
| HsCD33(1-16) | AAA51948 | 277 | 336 | 368 | 400 | 432 | 464 | 496 | 528 | 560 |
| VcCtxB(1-19) | BAA06291 | 278 | 337 | 369 | 401 | 433 | 465 | 497 | 529 | 561 |
| HsCST4(1-20) | NP_001890 | 279 | 338 | 370 | 402 | 434 | 466 | 498 | 530 | 562 |
| HsIns-iso1(1-24) | AAA59172 | 280 | 339 | 371 | 403 | 435 | 467 | 499 | 531 | 563 |
| HsSPARC(1-17) | CAA68724 | 281 | 340 | 372 | 404 | 436 | 468 | 500 | 532 | 564 |
| H1N1-HA(1-17) | ACQ45338 | 282 | 341 | 373 | 405 | 437 | 469 | 501 | 533 | 565 |
| HsMHCII(1-25) | CAA23783 | 310 | 342 | 374 | 406 | 438 | 470 | 502 | 534 | 566 |
| F(1-26) | AAK50553 | 311 | 343 | 375 | 407 | 439 | 471 | 503 | 535 | 567 |
| F(1-26) | AEZ01388 | 312 | 344 | 376 | 408 | 440 | 472 | 504 | 536 | 568 |
| F(1-26) | AAY43915 | 313 | 345 | 377 | 409 | 441 | 473 | 505 | 537 | 569 |
| F(1-26) | CBM41033 | 314 | 346 | 378 | 410 | 442 | 474 | 506 | 538 | 570 |
| F(1-26) | NP_047111 | 315 | 347 | 379 | 411 | 443 | 475 | 507 | 539 | 571 |
| F(1-25) | AEQ38114 | 316 | 348 | 380 | 412 | 444 | 476 | 508 | 540 | 572 |

Accordingly, in preferred embodiments, the at least one coding sequence of the artificial nucleic acid of the invention additionally encodes at least one further peptide or protein element selected from a secretory signal peptide, wherein the secretory signal peptide comprises an amino acid sequence being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 258-282, 310-316 (as provided in Table 3), or a fragment or variant of any of these sequences.

According to preferred embodiments, secretory signal peptides as provided in Table 3 may be N-terminally fused to Hendra virus F_deISS or SoIG proteins as provided in Table 1B or Hendra virus F_deISS or SoIG proteins as provided in Table 2B to generate antigenic Hendra and Nipah virus proteins optimized for secretion. Preferred embodiments of Hendra and Nipah virus proteins comprising heterologous N-terminal signal peptides are provided in Table 1B and Table 2B.

According to preferred embodiments, the nucleic acid sequence according to the invention comprises at least one coding sequence encoding a heterologous secretory signal sequence as defined above and, in addition, a Henipavirus antigenic peptide or protein being identical or at least 50%, 60%, 70%, 80%, 85%, 86%, 87%, 88%, 89%, 90%, 91%, 92%, 93%, 94%, 95%, 96%, 97%, 98%, or 99% identical to the amino acid sequences according to SEQ ID NOs: 807-832, 1041-1066 or a fragment or variant of any of these sequences.

Transmembrane Domains VLP Forming Domains Peptide Linker Self-Cleaving Peptides Helper Peptides:

According to another embodiment, the artificial nucleic acid sequence, particularly the RNA sequence according to the invention may additionally encode at least one transmembrane domain element. Transmembrane elements or membrane spanning polypeptide elements are present in proteins that are integrated or anchored in plasma membranes of cells. Typical transmembrane elements are alpha-helical transmembrane elements. Such transmembrane elements are composed essentially of amino acids with hydrophobic side chains, because the interior of a cell membrane (lipid bilayer) is also hydrophobic. From the structural perspective, transmembrane elements are commonly single hydrophobic alpha helices or beta barrel structures; whereas hydrophobic alpha helices are usually present in proteins that are present in membrane anchored proteins (e.g., seven transmembrane domain receptors), beta-barrel structures are often present in proteins that generate pores or channels. For target proteins, such as antigenic peptides or proteins according to the present invention (derived from Henipavirus, Hendra virus, Nipah virus) it may be beneficial to introduce a transmembrane element into the respective constructs. By addition of a transmembrane element to the target peptide/protein it may be possible to further enhance the immune response, wherein the translated target peptide/protein, e.g. a viral antigen, anchors to a target membrane, e.g. the plasma membrane of a cell, thereby increasing immune responses. This effect is also referred to as antigen clustering. When used in combination with a polypeptide or protein of interest in the context of the present invention, such transmembrane element can be placed N-terminal or C-terminal to the Henipavirus and/or Hendra virus and/or Nipah virus antigenic peptide or protein of interest. On nucleic acid level, the coding sequence for such transmembrane element is typically placed in frame (i.e. in the same reading frame), 5' or 3' to the coding sequence of the polypeptide as defined herein. The transmembrane domain may be selected from the transmembrane domain of Hemagglutinin (HA) of Influenza virus, Env of HIV-1. EIAV (equine infectious anaemia virus), MLV (murine leukaemia virus), mouse mammary tumor virus, G protein of VSV (vesicular stomatitis virus), Rabies virus, or a transmembrane element of a seven transmembrane domain receptor. Specific elements suitable in the context of the present invention are provided in the sequence listing (SEQ ID NOs: 283-294). On nucleic acid level, particularly RNA level, any nucleotide sequence moiety can be employed that encodes any transmembrane domain used in the present invention. Owing to the degenerated genetic code, in the case of most polypeptides SEQ ID NOs: 283-294, more than one particular nucleic acid sequence is conceivable as encoding the respective polypeptide. While each and every such nucleic acid may generally be used in the context of the present invention, it is preferable that the nucleic acid sequence that encodes the polypeptide sequence is selected such that its sequence is optimized according to the general guidance provided in this specification. Alternatively, any polypeptide element may be selected which is characterized by at least 80% identity, at least 85% identity, preferably at least 90% identity, and more preferably at least 95% identity to any of the sequences SEQ ID NOs: 283-294. On nucleic acid level, any polynucleotide (e.g. RNA) moiety may be selected which encodes such polypeptide element.

According to another embodiment, the artificial nucleic acid sequence, particularly the RNA sequence according to the invention may additionally encode at least one VLP forming domain. VLPs are self-assembled viral structural proteins (envelope proteins or capsid proteins) that structurally resemble viruses (without containing viral genetic material). VLPs contain repetitive high density displays of antigens which present conformational epitopes that can elicit strong T cell and B cell immune responses. When used in combination with a Henipavirus and/or Hendra virus and/or Nipah virus antigenic peptide or protein in the context of the present invention, such VLP forming element can be placed N-terminal or C-terminal to the polypeptide of interest. On nucleic acid level, the coding sequence for such VLP forming element is typically placed in frame (i.e. in the same reading frame), 5' or 3' to the coding sequence of the polypeptide as defined herein. For nucleic acid (e.g. RNA) encoding a polypeptide or protein of interest, particularly antigenic polypeptides or proteins (Henipavirus, Hendra virus, Nipah virus), it may be beneficial to introduce a VLP forming element into the respective constructs. In addition to the "clustering" of epitopes, an improved secretion of the VLP particle may also increase the immunogenicity of the respective antigen. VLP forming elements fused to an antigen may generate virus like particles containing repetitive high density displays of antigens. VLP forming elements may be selected e.g. from any one of SEQ ID NOs: 295-296. Essentially, such VLP forming elements can be chosen from any viral or phage capsid or envelope protein. VLP forming elements may be used as additional elements to promote or improve the particle formation of the target protein. Suitably, the polypeptide sequence of the VLP forming element used in the present invention is selected from the following list of polypeptide sequences (SEQ ID NOs: 295-296). On nucleic acid level, particularly RNA level, any nucleotide sequence moiety can be employed that encodes any of VLP forming element used in the present invention. Owing to the degenerated genetic code, in the case of most polypeptides SEQ ID NOs: 295-296, more than one particular nucleic acid sequence is conceivable as encoding the respective polypeptide of the below list. While each and every such nucleic acid may generally be used in the context of the present invention, it is preferable that the nucleic acid sequence that encodes the polypeptide sequence is selected such that its sequence is codon-optimized according to the general guidance provided in this specification. Alternatively, any polypeptide element may be selected which is characterized by at least 80% identity, at least 85% identity, preferably at least 90% identity, and more preferably at least 95% identity to any of the sequences SEQ ID NOs: 295-296. On nucleic acid level, any polynucleotide (e.g. RNA) moiety may be selected which encodes such polypeptide element.

According to another embodiment, the artificial nucleic acid sequence, particularly the RNA sequence according to the invention may additionally encode at least one peptide linker element. In protein constructs composed of several elements (e.g., Henipavirus antigenic peptide or protein fused to a transmembrane domain), the protein elements may be separated by peptide linker elements. Such elements may be beneficial because they allow for a proper folding of the individual elements and thereby the proper functionality of each element. Alternatively, the term "spacer" or "peptide spacer" is used herein. When used in the context of the present invention, such linkers or spacers are particularly useful when encoded by a nucleic acid encoding at least two functional protein elements, such as at least one polypeptide or protein of interest (Nipah virus and/or Hendra virus antigens) and at least one further protein or polypeptide element (e.g., VLP forming domain, transmembrane domain). In that case, the linker is typically located on the polypeptide chain in between the polypeptide of interest and the at least one further protein element. On nucleic acid level, the coding sequence for such linker is typically placed in the reading frame, 5' or 3' to the coding sequence for the polypeptide or protein of interest, or placed between coding regions for individual polypeptide domains of a given protein of interest. Peptide linkers are preferably composed of small, non-polar (e.g. Gly) or polar (e.g. Ser or Thr) amino acids. The small size of these amino acids provides flexibility, and allows for mobility of the connecting functional domains. The incorporation of Ser or Thr can maintain the stability of the linker in aqueous solutions by forming hydrogen bonds with the water molecules, and therefore reduces an interaction between the linker and the protein moieties. Rigid linkers generally maintain the distance between the protein domains and they may be based on helical structures and/or they have a sequence that is rich in proline. Cleavable linkers (also termed "cleavage linkers") allow for in vivo separation of the protein domains. The mechanism of cleavage may be based e.g. on reduction of disulfide bonds within the linker sequence or proteolytic cleavage. The cleavage may be mediated by an enzyme (enzymatic cleavage), e.g. the cleavage linker may provide a protease sensitive sequence (e.g., furin cleavage). A typical sequence of a flexible linker is composed of repeats of the amino acids Glycine (G) and Serine (S). For instance, the linker may have the following sequence: GS, GSG, SGG, SG, GGS, SGS, GSS, SSG. In some embodiments, the same sequence is repeated multiple times (e.g. two, three, four, five or six times) to create a longer linker. In other embodiments, a single amino acid residue such as S or G can be used as a linker. Linkers or spacers may be used as additional elements to promote or improve the secretion of the target protein (Henipavirus and/or Hendra virus and/or Nipah virus antigenic peptides or proteins). Suitably, the polypeptide sequence of the linker or spacer used in the present invention is selected from the following list of polypeptide sequences (SEQ ID NOs: 297-299). On nucleic acid level, particularly RNA level, any nucleotide sequence moiety can be employed that encodes any of linker or spacer used in the present invention. Owing to the degenerated genetic code, in the case of most polypeptides of SEQ ID NOs: 297-299, more than one particular nucleic acid sequence is conceivable as encoding the respective polypeptide list. While each and every such nucleic acid may generally be used in the context of the present invention, it is preferable that the nucleic acid sequence that encodes the polypeptide sequence is selected such that its sequence is optimized according to the general guidance provided in this specification. Alternatively, any polypeptide element may be selected which is characterized by at least 80% identity, at least 85% identity, preferably at least 90% identity, and more preferably at least 95% identity to any of the sequences SEQ ID NOs: 297-299. On nucleic acid level, any polynucleotide (e.g. RNA) moiety may be selected which encodes such polypeptide element.

According to another embodiment, the artificial nucleic acid sequence, particularly the RNA sequence according to the invention may additionally encode at least one self-cleaving peptide. Viral self-cleaving peptides (2A peptides) allow the expression of multiple proteins from a single open reading frame. The terms 2A peptide and 2A element are used interchangeably herein. The mechanism by the 2A sequence for generating two proteins from one transcript is by ribosome skipping—a normal peptide bond is impaired at 2A, resulting in two discontinuous protein fragments from one translation event. When used in the context of the present invention, such 2A peptides are particularly useful when encoded by a nucleic acid encoding at least two functional protein elements (e.g. Henipavirus and/or Hendra virus and/or Nipah virus antigenic peptides or proteins). In general, a 2A element is useful when the nucleic acid molecule encodes at least one polypeptide or protein of interest and at least one further protein element. In a preferred embodiment, a 2A element is present when the polynucleotide of the invention encodes two proteins or polypeptides of interest, e.g. two antigens. The coding sequence for such 2A peptide is typically located in between the coding sequence of the polypeptide of interest and the coding sequence of the least one further protein element (which may also be a polypeptide of interest), so that cleavage of the 2A peptide leads to two separate polypeptide molecules, at least one of them being a polypeptide or protein of interest. For example, for expressing target proteins (Henipavirus and/or Hendra virus and/or Nipah virus antigenic peptides or proteins) that are composed of several polypeptide chains, such as antibodies, it may be beneficial to provide coding information for both polypeptide chains on a single nucleic acid molecule, separated by a nucleic acid sequence encoding a 2A peptide. 2A peptides may also be beneficial when cleavage of the protein of interest from another encoded polypeptide element is desired. 2A peptides may be derived from foot-and-mouth diseases virus, from equine rhinitis A virus, Thosea asigna virus, Porcine teschovirus-1. Suitably, the polypeptide sequence of the 2A peptide used in the present invention may be selected from the following list of polypeptide sequences (SEQ ID NOs: 300-303). On nucleic acid level, particularly RNA level, any nucleotide sequence moiety can be employed that encodes any of 2A peptide used in the present invention. Owing to the degenerated genetic code, in the case of most polypeptides (SEQ ID NOs: 300-303), more than one particular nucleic acid sequence is conceivable as encoding the respective polypeptide. While each and every such nucleic acid may generally be used in the context of the present invention, it is preferable that the nucleic acid sequence that encodes the polypeptide sequence is selected such that its sequence is optimized according to the general guidance provided in this specification. Alternatively, any polypeptide element may be selected which is characterized by at least 80% identity, at least 85% identity, preferably at least 90% identity, and more preferably at least 95% identity to any of the sequences SEQ ID NOs: 300-303. On nucleic acid level, any polynucleotide (e.g. RNA) moiety may be selected which encodes such polypeptide element.

According to another embodiment, the artificial nucleic acid sequence, particularly the RNA sequence according to the invention may additionally encode at least one helper peptide. In essence, helper peptides binds to class II MHC molecules as a nonspecific vaccine helper epitope (adjuvant) and induces an increased (and long term) immune response by increasing the helper T-cell response. In an embodiment, such a helper peptide may be N-terminally and/or C-terminally fused to the antigenic peptide or protein derived from Henipavirus, Nipah virus or Hendra virus. In an embodiment, the helper peptide is derived from tetanus toxin, according to SEQ ID NO: 257. On nucleic acid level, particularly RNA level, any nucleotide sequence moiety can be employed that encodes any helper peptide used in the present invention. Owing to the degenerated genetic code, in the case of most polypeptides (SEQ ID NO: 257), more than one particular nucleic acid sequence is conceivable as encoding the respective polypeptide. While each and every such nucleic acid may generally be used in the context of the present invention, it is preferable that the nucleic acid sequence that encodes the polypeptide sequence is selected such that its sequence is optimized according to the general guidance provided in this specification. Alternatively, any polypeptide element may be selected which is characterized by at least 80% identity, at least 85% identity, preferably at least 90% identity, and more preferably at least 95% identity to any of the sequences SEQ ID NO: 257. On nucleic acid level, any polynucleotide (e.g. RNA) moiety may be selected which encodes such polypeptide element.

Henipavirus Nucleic Acids:

In the context of the invention, the coding sequence encoding the at least one Henipavirus antigenic peptide or protein or fragment, variant or derivative thereof, may be selected from any nucleic acid sequence comprising a coding sequence encoding Henipavirus RNA-directed RNA polymerase (L), Henipavirus fusion protein (F), Henipavirus non-structural protein (V), Henipavirus glycoprotein (G), Henipavirus nucleoprotein (N), Henipavirus matrix protein (M), Henipavirus phosphoprotein (P), Henipavirus protein C, and Henipavirus protein W. In the context of the invention, said artificial nucleic acid sequences may be derived from any Henipavirus strain, species, serotype, subtype fragment or variant thereof (e.g. as provided above in the section "Henipavirus").

The artificial nucleic acid of the invention may comprise or consist of at least one coding sequence encoding at least one Henipavirus antigenic peptide or protein as defined herein, preferably encoding any one of SEQ ID NOs: 1-26, 573-598, 807-832, 1041-1066, 1513-1515 or fragments of variants thereof. It has to be understood that, on nucleic acid level, any nucleic acid sequence (e.g. DNA sequence, RNA sequence) which encodes an amino acid sequences being identical to SEQ ID NOs: 1-26, 573-598, 807-832, 1041-1066, 1513-1515 or fragments or variants thereof, or any nucleic acid sequence (e.g. DNA sequence, RNA sequence) which encodes amino acid sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 573-598, 807-832, 1041-1066, 1513-1515 or fragments or variants thereof, may be selected and may accordingly be understood as suitable coding sequence and may therefore be comprised in the artificial nucleic acid of the invention.

According to a preferred embodiment, the inventive artificial nucleic acid comprises or consists of at least one coding sequence encoding at least one Henipavirus antigenic peptide or protein as described herein. Preferably, the inventive artificial nucleic acid comprises or consists of a coding sequence according to any one of SEQ ID NOs: 27-234, 599-806, 833-1040, 1067-1274, 1275-1508, 1516-1539, 1540-1548 or a homolog, fragment or variant of any of these sequences.

The artificial nucleic acid according to any one of the preceding claims, wherein the at least one coding sequence comprises at least one of the RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to SEQ ID NOs: 27-234, 599-806, 833-1040, 1067-1274, 1275-1508, 1516-1539, 1540-1548 or at least one of the RNA sequences which are capable of hybridizing with a complement sequence derived from SEQ ID NOs: 27-234, 599-806, 833-1040, 1067-1274, 1275-1508, 1516-1539, 1540-1548 or a fragment or variant or orthologue or paralogue of any of these.

It is further preferred that the nucleic acid sequence according to the invention comprises at least one coding sequence encoding a heterologous secretory signal sequence comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs 317-572 or a fragment or variant thereof and, in addition, at least one coding sequence encoding a Henipavirus antigenic peptide or protein comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 599-806 or a fragments or variants any of these sequences.

In this context, it is preferred that the nucleic acid sequence according to the invention comprises at least one coding sequence encoding a heterologous secretory signal sequence and, in addition, at least one coding sequence encoding a Henipavirus antigenic peptide or protein comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 833-1040, 1067-1274, 1516-1539 or a fragments or variants any of these sequences.

Hendra Virus Nucleic Acids:

In the context of the invention, the coding sequence encoding the at least one Hendra virus antigenic peptide or protein or fragment, variant or derivative thereof, may be selected from any nucleic acid sequence comprising a coding sequence encoding Hendra virus RNA-directed RNA polymerase (L), Hendra virus fusion protein (F), Hendra virus non-structural protein (V), Hendra virus glycoprotein (G), Hendra virus nucleoprotein (N), Hendra virus matrix protein (M), Hendra virus phosphoprotein (P), Hendra virus protein C, and Hendra virus protein W. In the context of the invention, said artificial nucleic acid sequences may be derived from any Hendra virus strain, species, serotype, subtype fragment or variant thereof.

According to a preferred embodiment, the inventive artificial nucleic acid comprises or consists of at least one coding sequence encoding at least one Hendra virus antigenic peptide or protein as described herein. Preferably, the inventive artificial nucleic acid comprises or consists of a coding sequence according to any one of SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274, 1282-1285, 1293-1300, 1308-1311, 1319-1326, 1334-1337, 1345-1352, 1360-1363, 1371-1378, 1386-1389, 1397-1404, 1412-1415, 1423-1430, 1438-1441, 1464-1467, 1490-1493, 1449-1456, 1475-1482, 1501-1508 or a homolog, fragment or variant of any of these sequences.

Preferably, the nucleic acid sequence according to the invention comprises at least one coding sequence encoding Hendra virus antigenic peptide or protein comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274, 1282-1285, 1293-1300, 1308-1311, 1319-1326, 1334-1337, 1345-1352, 1360-1363, 1371-1378, 1386-1389, 1397-1404, 1412-1415, 1423-1430, 1438-1441, 1464-1467, 1490-1493, 1449-1456, 1475-1482, 1501-1508 or a homolog, fragment or variant of any of these sequences, or at least one of the nucleic acid sequences which are capable of hybridizing with a complement sequence derived from SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274, 1282-1285, 1293-1300, 1308-1311, 1319-1326, 1334-1337, 1345-1352, 1360-1363, 1371-1378, 1386-1389, 1397-1404, 1412-1415, 1423-1430, 1438-1441, 1464-1467, 1490-1493, 1449-1456, 1475-1482, 1501-1508 or a fragment or variant or orthologue or paralogue of any of these.

In a preferred embodiment, the present invention thus provides artificial nucleic acid sequences comprising at least one coding sequence, wherein the coding sequence encoding Hendra virus fusion protein (F) comprises or consists of any one of the nucleic acid sequences defined in Table 1 and Table 1B, a homolog, fragment or variant of any one of these sequences.

In particularly preferred embodiments the nucleic acid sequence comprises or consists of at least one coding sequence encoding Hendra virus fusion protein (F) according to SEQ ID NOs: 34-37, 60-63, 86-89, 112-115, 138-141, 164-167, 190-193, 216-219, 606-609, 632-635, 658-661, 684-687, 710-713, 736-739, 762-765, 788-791, 840-843, 866-869, 892-895, 918-921, 944-947, 970-973, 996-999, 1022-1025, 1074-1077, 1100-1103, 1126-1129, 1152-1155, 1178-1181, 1204-1207, 1230-1233, 1256-1259, or a homolog, fragment or variant of any of these sequences.

Preferably, the nucleic acid sequence according to the invention comprises at least one coding sequence encoding Hendra virus fusion protein (F) comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 34-37, 60-63, 86-89, 112-115, 138-141, 164-167, 190-193, 216-219, 606-609, 632-635, 658-661, 684-687, 710-713, 736-739, 762-765, 788-791, 840-843, 866-869, 892-895, 918-921, 944-947, 970-973, 996-999, 1022-1025, 1074-1077, 1100-1103, 1126-1129, 1152-1155, 1178-1181, 1204-1207, 1230-1233, 1256-1259 and as disclosed in Table 1 and Table 1B.

In a preferred embodiment, the present invention thus provides artificial nucleic acid sequences comprising at least one coding sequence, wherein the coding sequence encoding Hendra virus glycoprotein (G) comprises or consists of any one of the nucleic acid sequences defined in Table 1 and Table 1B, a homolog, fragment or variant of any one of these sequences.

In particularly preferred embodiments the nucleic acid sequence comprises or consists of at least one coding sequence encoding Hendra virus glycoprotein (G) according to SEQ ID NOs: 45-52, 71-78, 97-104, 123-130, 149-156, 175-182, 201-208, 227-234, 617-624, 643-650, 669-676, 695-702, 721-728, 747-754, 773-780, 799-806, 851-858, 877-884, 903-910, 929-936, 955-962, 981-988, 1007-1014, 1033-1040, 1085-1092, 1111-1118, 1137-1144, 1163-1170, 1189-1196, 1215-1222, 1241-1248, 1267-1274, or a homolog, fragment or variant of any of these sequences.

Preferably, the nucleic acid sequence according to the invention comprises at least one coding sequence encoding Hendra virus glycoprotein (G) comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 45-52, 71-78, 97-104, 123-130, 149-156, 175-182, 201-208, 227-234, 617-624, 643-650, 669-676, 695-702, 721-728, 747-754, 773-780, 799-806, 851-858, 877-884, 903-910, 929-936, 955-962, 981-988, 1007-1014, 1033-1040, 1085-1092, 1111-1118, 1137-1144, 1163-1170, 1189-1196, 1215-1222, 1241-1248, 1267-1274, and as disclosed in Table 1 and Table 1B.

It is further preferred that the nucleic acid sequence according to the invention comprises at least one coding sequence encoding a heterologous secretory signal sequence comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 317-572 or a fragment or variant thereof and, in addition, at least one coding sequence encoding a Hendra virus antigenic peptide or protein comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 606-609, 632-635, 658-661, 684-687, 710-713, 736-739, 762-765, 788-791, 617-624, 643-650, 669-676, 695-702, 721-728, 747-754, 773-780, 799-806 or a homolog, fragment or variant of any of these sequences.

In this context, it is preferred that the nucleic acid sequence according to the invention comprises at least one coding sequence encoding a heterologous secretory signal sequence and, in addition, at least one coding sequence encoding a Hendra virus antigenic peptide or protein comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274 or a homolog, fragment or variant of any of these sequences.

In another embodiment the nucleic acid sequence comprises or consists of at least one coding sequence encoding Hendra virus RNA-directed RNA polymerase (L), or a fragment or variant thereof. In another embodiment the nucleic acid sequence comprises or consists of at least one coding sequence encoding Hendra virus non-structural protein (V), or a fragment or variant thereof. In another embodiment the nucleic acid sequence comprises or consists of at least one coding sequence encoding Hendra virus nucleoprotein (N), or a fragment or variant thereof. In another embodiment the nucleic acid sequence comprises or consists of at least one coding sequence encoding Hendra virus matrix protein (M), or a fragment or variant thereof. In another embodiment the nucleic acid sequence comprises or consists of at least one coding sequence encoding Hendra virus phosphoprotein (P), or a fragment or variant thereof. In another embodiment the nucleic acid sequence comprises or consists of at least one coding sequence encoding Hendra virus protein C, or a fragment or variant thereof. In another embodiment the nucleic acid sequence comprises or consists of at least one coding sequence encoding Hendra virus protein W, or a fragment or variant thereof.

The inventive artificial nucleic acid encoding Hendra virus antigenic peptide or protein, preferably the at least one coding sequence of the artificial nucleic acid according to the invention, may comprise or consist of a variant of a nucleic acid sequence as defined herein, preferably of a nucleic acid sequence encoding a protein or a fragment thereof as defined herein. The expression "variant of a nucleic acid sequence" as used herein in the context of a nucleic acid sequence encoding a protein or a fragment thereof, typically refers to a nucleic acid sequence, which differs by at least one nucleic acid residue from the respective naturally occurring nucleic acid sequence encoding a protein or a fragment thereof. More preferably, the expression "variant of a nucleic acid sequence" refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence, from which it is derived.

Nipah Virus Nucleic Acids:

In the context of the invention, the coding sequence encoding the at least one Nipah virus antigenic peptide or protein or fragment, variant or derivative thereof, may be selected from any nucleic acid sequence comprising a coding sequence encoding Nipah virus RNA-directed RNA polymerase (L), Nipah virus fusion protein (F), Nipah virus non-structural protein (V), Nipah virus glycoprotein (G), Nipah virus nucleoprotein (N), Nipah virus matrix protein (M), Nipah virus phosphoprotein (P), Nipah virus protein C, and Nipah virus protein W. In the context of the invention, said artificial nucleic acid sequences may be derived from any Nipah virus strain, species, serotype, subtype fragment or variant thereof.

According to a preferred embodiment, the inventive artificial nucleic acid comprises or consists of at least one coding sequence encoding at least one Nipah virus antigenic peptide or protein as described herein. Preferably, the inventive artificial nucleic acid comprises or consists of a coding sequence according to any one of SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1275-1281, 1286-1292, 1301-1307, 1312-1318, 1327-1333, 1338-1344, 1353-1359, 1364-1370, 1379-1385, 1390-1396, 1405-1411, 1416-1422, 1431-1437, 1457-1463, 1483-1489, 1442-1448, 1468-1474, 1494-1500, 1516-1539, 1540-1548 or a homolog, fragment or variant of any of these sequences.

Preferably, the nucleic acid sequence according to the invention comprises at least one coding sequence encoding Nipah virus antigenic peptide or protein comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1275-1281, 1286-1292, 1301-1307, 1312-1318, 1327-1333, 1338-1344, 1353-1359, 1364-1370, 1379-1385, 1390-1396, 1405-1411, 1416-1422, 1431-1437, 1457-1463, 1483-1489, 1442-1448, 1468-1474, 1494-1500, 1516-1539, 1540-1548 or a homolog, fragment or variant of any of these sequences, or at least one of the nucleic acid sequences which are capable of hybridizing with a complement sequence derived from SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1275-1281, 1286-1292, 1301-1307, 1312-1318, 1327-1333, 1338-1344, 1353-1359, 1364-1370, 1379-1385, 1390-1396, 1405-1411, 1416-1422, 1431-1437, 1457-1463, 1483-1489, 1442-1448, 1468-1474, 1494-1500, 1516-1539, 1540-1548 or a fragment or variant or orthologue or paralogue of any of these.

In a preferred embodiment, the present invention provides artificial nucleic acid sequences comprising at least one coding sequence, wherein the coding sequence encoding Nipah virus fusion protein (F) comprises or consists of any one of the nucleic acid sequences defined in Table 2 and Table 2B, a homolog, fragment or variant of any one of these sequences.

In particularly preferred embodiments the nucleic acid sequence comprises or consists of at least one coding sequence encoding Nipah virus fusion protein (F) according to SEQ ID NOs: 27-33, 53-59, 79-85, 105-111, 131-137, 157-163, 183-189, 209-215, 599-605, 625-631, 651-657, 677-683, 703-709, 729-735, 755-761, 781-787, 833-839, 859-865, 885-891, 911-917, 937-943, 963-969, 989-995, 1015-1021, 1067-1073, 1093-1099, 1119-1125, 1145-1151, 1171-1177, 1197-1203, 1223-1229, 1249-1255, 1516-1539 or a homolog, fragment or variant of any of these sequences.

Preferably, the nucleic acid sequence according to the invention comprises at least one coding sequence encoding Nipah virus fusion protein (F) comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 27-33, 53-59, 79-85, 105-111, 131-137, 157-163, 183-189, 209-215, 599-605, 625-631, 651-657, 677-683, 703-709, 729-735, 755-761, 781-787, 833-839, 859-865, 885-891, 911-917, 937-943, 963-969, 989-995, 1015-1021, 1067-1073, 1093-1099, 1119-1125, 1145-1151, 1171-1177, 1197-1203, 1223-1229, 1249-1255, 1516-1539 and as disclosed in Table 2 and Table 2B.

In a preferred embodiment, the present invention provides artificial nucleic acid sequences comprising at least one coding sequence, wherein the coding sequence encoding Nipah virus glycoprotein (G) comprises or consists of any one of the nucleic acid sequences defined in Table 2 and Table 2B, a homolog, fragment or variant of any one of these sequences.

In particularly preferred embodiments the nucleic acid sequence comprises or consists of at least one coding sequence encoding Nipah virus glycoprotein (G) according to SEQ ID NOs: 38-44, 64-70, 90-96, 116-122, 142-148, 168-174, 194-200, 220-226, 610-616, 636-642, 662-668, 688-694, 714-720, 740-746, 766-772, 792-798, 844-850, 870-876, 896-902, 922-928, 948-954, 974-980, 1000-1006, 1026-1032, 1078-1084, 1104-1110, 1130-1136, 1156-1162, 1182-1188, 1208-1214, 1234-1240, 1260-1266, or a homolog, fragment or variant of any of these sequences.

Preferably, the nucleic acid sequence according to the invention comprises at least one coding sequence encoding Nipah virus glycoprotein (G) comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 38-44, 64-70, 90-96, 116-122, 142-148, 168-174, 194-200, 220-226, 610-616, 636-642, 662-668, 688-694, 714-720, 740-746, 766-772, 792-798, 844-850, 870-876, 896-902, 922-928, 948-954, 974-980, 1000-1006, 1026-1032, 1078-1084, 1104-1110, 1130-1136, 1156-1162, 1182-1188, 1208-1214, 1234-1240, 1260-1266, and as disclosed in Table 2 and Table 2B.

It is further preferred that the nucleic acid sequence according to the invention comprises at least one coding sequence encoding a heterologous secretory signal sequence comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 317-572 or a fragment or variant thereof and, in addition, at least one coding sequence encoding a Nipah virus antigenic peptide or protein comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 599-605, 625-631, 651-657, 677-683, 703-709, 729-735, 755-761, 781-787, 610-616, 636-642, 662-668, 688-694, 714-720, 740-746, 766-772, 792-798 or a homolog, fragment or variant of any of these sequences.

In this context, it is preferred that the nucleic acid sequence according to the invention comprises at least one coding sequence encoding a heterologous secretory signal sequence and, in addition, at least one coding sequence encoding a Nipah virus antigenic peptide or protein comprising a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the nucleic acid sequences according to SEQ ID NOs: 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1516-1539 or a homolog, fragment or variant of any of these sequences.

In another embodiment the nucleic acid sequence comprises or consists of at least one coding sequence encoding Nipah virus RNA-directed RNA polymerase (L), or a fragment or variant thereof. In another embodiment the nucleic acid sequence comprises or consists of at least one coding sequence encoding Nipah virus non-structural protein (V), or a fragment or variant thereof. In another embodiment the nucleic acid sequence comprises or consists of at least one coding sequence encoding Nipah virus nucleoprotein (N), or a fragment or variant thereof. In another embodiment the nucleic acid sequence comprises or consists of at least one coding sequence encoding Nipah virus matrix protein (M), or a fragment or variant thereof. In another embodiment the nucleic acid sequence comprises or consists of at least one coding sequence encoding Nipah virus phosphoprotein (P), or a fragment or variant thereof. In another embodiment the nucleic acid sequence comprises or consists of at least one coding sequence encoding Nipah virus protein C, or a fragment or variant thereof. In another embodiment the nucleic acid sequence comprises or consists of at least one coding sequence encoding Nipah virus protein W, or a fragment or variant thereof.

The inventive artificial nucleic acid encoding Nipah virus antigenic peptide or protein, preferably the at least one coding sequence of the artificial nucleic acid according to the invention, may comprise or consist of a variant of a nucleic acid sequence as defined herein, preferably of a nucleic acid sequence encoding a protein or a fragment thereof as defined herein. The expression "variant of a nucleic acid sequence" as used herein in the context of a nucleic acid sequence encoding a protein or a fragment thereof, typically refers to a nucleic acid sequence, which differs by at least one nucleic acid residue from the respective naturally occurring nucleic acid sequence encoding a protein or a fragment thereof. More preferably, the expression "variant of a nucleic acid sequence" refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence, from which it is derived.

In specific embodiments, the at least one coding sequence comprises at least one of the DNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of the sequences SEQ ID NOs: 27-234, 599-806, 833-1040, 1067-1274, 1275-1508, 1516-1539, 1540-1548 wherein the indicated uridine nucleotides are substituted with thymidine nucleotides, or a fragment or variant or orthologue or paralogue of any of these.

Mono-, Bi- and Multicistronic and Multi-Antigen Nucleic Acids:

According to certain embodiments of the present invention, the artificial nucleic acid is mono-, bi-, or multicistronic, preferably as defined herein.

In specific embodiments the artificial nucleic acid of the invention is monocistronic, wherein the (one) coding sequence encodes at least two different Hendra virus and/or Nipah virus antigenic peptides or proteins, or a fragment or variant thereof.

The coding sequences in a bi- or multicistronic nucleic acid molecule preferably encode distinct Henipavirus antigenic proteins or peptides, Hendra virus antigenic proteins or peptides, Nipah virus antigenic proteins or peptides as defined herein or a fragment or variant thereof. Preferably, the coding sequences encoding two or more antigenic proteins or peptides may be separated in the bi- or multicistronic nucleic acid by at least one IRES (internal ribosomal entry site) sequence, as defined below.

In specific embodiments the artificial nucleic acid of the invention is bi- or multicistronic and comprises at least two coding sequences, wherein the at least two coding sequences encode at least two different Hendra virus and/or Nipah virus antigenic peptides or proteins, or a fragment or variant of any of these.

Thus, the term "encoding two or more antigenic peptides or proteins" or "encode at least two different Hendra virus and/or Nipah virus antigenic peptides or proteins" may mean, without being limited thereto, that the bi- or even multicistronic nucleic acid, may encode e.g. at least two, three, four, five, six or more (preferably different) Henipavirus antigenic peptides or proteins and/or Hendra virus antigenic proteins or peptides and/or Nipah virus antigenic proteins or peptides derived from different viruses or their fragments or variants within the definitions provided herein. More preferably, without being limited thereto, the bi- or even multicistronic nucleic acid, may encode, for example, at least two, three, four, five, six or more (preferably different) Henipavirus antigenic peptides or proteins and/or Hendra virus antigenic proteins or peptides and/or Nipah virus antigenic proteins or peptides as defined herein or their fragments or variants as defined herein. In this context, a so-called IRES (internal ribosomal entry site) sequence as defined above can function as a sole ribosome binding site, but it can also serve to provide a bi- or even multicistronic nucleic acid as defined above, which encodes several Henipavirus antigenic peptides or proteins and/or Hendra virus antigenic proteins or peptides and/or Nipah virus antigenic proteins or peptides which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (Sly) or cricket paralysis viruses (CrPV).

Particular suitable IRES sequences that may be used in the context of the invention may be IRES sequences derived from EMCV (SEQ ID NO: 304) and IRES sequences derived from FMDV (SEQ ID NO: 305).

According to a further embodiment the at least one coding sequence of the nucleic acid sequence according to the invention may encode at least two, three, four, five, six, seven, eight and more Henipavirus antigenic peptides or proteins and/or Hendra virus antigenic proteins or peptides and/or Nipah virus antigenic proteins or peptides (or fragments and derivatives thereof) as defined herein linked with or without an amino acid linker sequence, wherein said linker sequence can comprise rigid linkers, flexible linkers, cleavable linkers (e.g., self-cleaving peptides) or a combination thereof (see paragraph "Peptide linker elements" of the present invention). Therein, the Henipavirus antigenic peptides or proteins and/or Hendra virus antigenic proteins or peptides and/or Nipah virus antigenic proteins or peptides may be identical or different or a combination thereof. Particular Henipavirus antigenic peptides or proteins and/or Hendra virus antigenic proteins or peptides and/or Nipah virus antigenic proteins or peptides combinations can be encoded by said nucleic acid encoding at least two Henipavirus antigenic peptides or proteins and/or Hendra virus antigenic proteins or peptides and/or Nipah virus antigenic proteins or peptides as explained herein (also herein referred to as "multi-antigen-constructs/nucleic acid").

It has to be noted, that in the context of the invention, certain combinations of coding sequences (e.g., comprising at least two different Henipavirus antigenic peptides or proteins and/or Hendra virus antigenic proteins or peptides and/or Nipah virus antigenic proteins or peptides and/or comprising at least two antigenic peptides or proteins derived from a genetically different Henipavirus, Hendra virus, Nipah virus) may be generated by any combination of moni- bi- and multicistronic nucleic acids and/or multi-antigen-constructs/nucleic acid to obtain a poly- or even multivalent nucleic acid mixture.

Preferably, the at least one coding sequence of the nucleic acid sequence according to the invention comprises at least two, three, four, five, six, seven, eight or more nucleic acid sequences identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences disclosed according to SEQ ID NOs: 27-234, 599-806, 833-1040, 1067-1274, 1275-1508, 1516-1539, 1540-1548 or a fragment or variant of any one of said nucleic acid sequences.

Preferably, the nucleic acid sequence comprising at least one coding sequence as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

According to a further embodiment, the nucleic acid sequence according to the invention is an artificial nucleic acid sequence as defined herein.

RNA:

In embodiments, the artificial nucleic acid is an RNA, in particular a circular RNA. As used herein, "circular RNA" has to be understood as a circular polynucleotide that can encode at least one antigenic peptide or protein as defined herein. Accordingly, in preferred embodiments, said circular RNA comprises at least one coding sequence encoding at least one antigenic peptide or protein derived from a Henipavirus or a fragment or variant thereof as defined herein.

The production of circRNAs can be performed using various methods provided in the art. For example, U.S. Pat. No. 6,210,931 teaches a method of synthesizing circRNAs by inserting DNA fragments into a plasmid containing sequences having the capability of spontaneous cleavage and self-circularization. U.S. Pat. No. 5,773,244 teaches producing circRNAs by making a DNA construct encoding an RNA cyclase ribozyme, expressing the DNA construct as an RNA, and then allowing the RNA to self-splice, which produces a circRNA free from intron in vitro. WO1992001813 teaches a process of making single strand circular nucleic acids by synthesizing a linear polynucleotide, combining the linear nucleotide with a complementary linking oligonucleotide under hybridization conditions, and ligating the linear polynucleotide. The person skilled in the art may also use methods provided in WO2015034925 or WO2016011222 to produce circular RNA. Accordingly, methods for producing circular RNA as provided in U.S. Pat. Nos. 6,210,931, 5,773,244, WO1992001813, WO2015034925 and WO2016011222 are incorporated herewith by reference.

In a preferred embodiment, the artificial nucleic acid is an RNA, preferably an mRNA.

The artificial RNA according to the present invention may be prepared using any method known in the art, including chemical synthesis such as e.g. solid phase RNA synthesis, as well as in vitro methods, such as RNA in vitro transcription reactions.

In a preferred embodiment, the artificial nucleic acid as defined herein, preferably the RNA as defined herein, is obtained by RNA in vitro transcription. Accordingly, the RNA of the invention is preferably an in vitro transcribed RNA.

The terms "RNA in vitro transcription" or "in vitro transcription" relate to a process wherein RNA is synthesized in a cell-free system (in vitro) as defined above. DNA, particularly plasmid DNA (or PCR product), is typically used as template for the generation of RNA transcripts.

In embodiments, the nucleotide mixture used in RNA in vitro transcription may additionally contain modified nucleotides as defined herein. In embodiments, the nucleotide mixture (i.e. the fraction of each nucleotide in the mixture) may be optimized for the given RNA sequence, preferably as described WO2015/188933.

In embodiment where more than one different artificial nucleic acid as defined herein has to be produced, e.g. where 2, 3, 4, 5, 6, 7, 8, 9, 10 or even more different artificial nucleic acids have to be produced (e.g. encoding different antigenic peptides, proteins of Hendra and/or Nipah virus), procedures as described in WO2017/109134 may be suitably used.

In the context of nucleic acid vaccine production, it may be required to provide GMP-grade RNA. GMP-grade RNA may be suitably produced using a manufacturing process approved by regulatory authorities. Accordingly, in a particularly preferred embodiment, RNA production is performed under current good manufacturing practice (GMP), implementing various quality control steps on DNA and RNA level, according to WO2016/180430. Accordingly, the RNA of the invention is a GMP-grade RNA, particularly a GMP-grade mRNA.

The obtained RNA products are preferably purified using PureMessenger® (CureVac, Tübingen, Germany; RP-HPLC according to WO2008/077592) and/or tangential flow filtration (as described in WO2016/193206).

In a preferred embodiment, the RNA, particularly the purified RNA, is lyophilized according to WO2016/165831 or WO2011/069586 to yield a temperature stable dried artificial nucleic acid (powder) as defined herein. The RNA of the invention, particularly the purified RNA may also be dried using spray-drying or spray-freeze drying according to WO2016/184575 or WO2016184576 to yield a temperature stable artificial nucleic acid (powder) as defined herein. Accordingly, in the context of manufacturing and purifying nucleic acids, particularly RNA, the disclosures of WO2017/109161, WO2015/188933, WO2016/180430, WO2008/077592, WO2016/193206, WO2016/165831, WO2011/069586, WO2016/184575, and WO2016/184576 are incorporated herewith by reference.

Accordingly, in preferred embodiments the RNA is a dried RNA, particularly a dried mRNA.

The term "dried RNA" as used herein has to be understood as RNA that has been lyophilized, or spray-dried, or spray-freeze dried as defined above to obtain a temperature stable dried RNA (powder).

Accordingly, in preferred embodiments the RNA is a purified RNA, particularly purified mRNA.

The term "purified RNA" as used herein has to be understood as RNA which has a higher purity after certain purification steps (e.g. HPLC, TFF, precipitation steps) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases, BSA, pyrophosphatase, restriction endonuclease, DNase), spermidine, abortive RNA sequences, RNA fragments, free nucleotides (modified nucleotides, conventional NTPs, cap analogue), plasmid DNA fragments, buffer components (HEPES, TRIS, MgCl$_2$) etc. Other impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full length RNA transcripts is as close as possible to 100%. Accordingly "purified RNA" as used herein has a degree of purity of more than 70%, 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

It has to be understood that "dried RNA" as defined herein and "purified RNA" as defined herein or "GMP-grade mRNA" as defined herein may have superior stability characteristics and improved efficiency (e.g. better translatability of the mRNA in vivo).

Nucleic Acid Modifications:

According to a further embodiment, the nucleic acid sequence according to the invention is a modified nucleic acid sequence, preferably a modified RNA sequence as described herein. In this context, a modification as defined herein preferably leads to a stabilization of the nucleic acid sequence according to the invention. More preferably, the invention thus provides a nucleic acid sequence, more preferably a stabilized RNA sequence comprising at least one coding sequence as defined herein.

According to one embodiment, the nucleic acid sequence of the present invention may thus be provided as a "stabilized nucleic acid sequence", preferably as a "stabilized RNA sequence", that is to say as an nucleic acid sequence or the RNA that is essentially resistant to in vivo degradation (e.g. by an exo- or endo-nuclease).

Such stabilization may be effected by providing a "dried RNA" and/or a "purified RNA" as specified herein. Alternatively or in addition to that, such stabilization can be effected, for example, by a modified phosphate backbone of the nucleic acid, particularly of the RNA of the present invention. A backbone modification in connection with the present invention is a modification in which phosphates of the backbone of the nucleotides contained in the nucleic acid or the RNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized nucleic acids or RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the RNA as defined herein.

Chemical Modifications of Nucleic Acids:

The term "RNA modification" as used herein may refer to chemical modifications comprising backbone modifications as well as sugar modifications or base modifications. In this context, a modified RNA (sequence) as defined herein may contain nucleotide analogues/modifications, e.g. backbone modifications, sugar modifications or base modifications. A backbone modification in connection with the present invention is a modification, in which phosphates of the backbone of the nucleotides contained in an RNA as defined herein are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the RNA. In this context, nucleotide analogues or modifications are preferably selected from nucleotide analogues, which are applicable for transcription and/or translation. The modified nucleosides and nucleotides, which may be incorporated into a modified nucleic acid or RNA as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH2CH2O)nCH2CH2OR; "locked" nucleic acids (SNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy. "Deoxy" modifications include hydrogen, amino (e.g. NH2; alkylamino, dialkylamino, heterocyclyl, arylamino, diary) amino, heteroaryl amino, diheteroaryl amino, or amino acid); or the amino group can be attached to the sugar through a linker, wherein the linker comprises one or more of the atoms C, N, and O. The sugar group can also contain one or more carbons that possess the opposite stereochemical configuration than that of the corresponding carbon in ribose. Thus, a modified RNA can include nucleotides containing, for instance, arabinose as the sugar. The phosphate backbone may further be modified in the modified nucleosides and nucleotides, which may be incorporated into a modified nucleic acid or a modified RNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates). The modified nucleosides and nucleotides, which may be incorporated into a modified nucleic acid or particularly into a modified RNA as described herein, can further be modified in the nucleobase moiety. Examples of nucleobases particularly found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group. In particularly preferred embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5"-triphosphate, 5-Bromo-2'-deoxyuridine-5'-triphosphate, 5-iodocytidine-5'-triphosphate, 5-Iodo-2% deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5"-triphosphate, O6-methylguanosine-5'-triphosphate, pseudouridine-5'-triphosphate, or puromycin-5"-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate. In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine. In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine. In other embodiments, modified nucleosides include 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine. In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine. In further specific embodiments, nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Particularly preferred and suitable in the context of the invention are pseudouridine (ψ), N1-methylpseudouridine (m1ψ), 5-methylcytosine, and 5-methoxyuridine. Accordingly, the artificial nucleic acid as defined herein may comprise at least one modified nucleotide selected from pseudouridine (ψ), N1-methylpseudouridine (m1ψ), 5-methylcytosine, and 5-methoxyuridine.

According to a further embodiment, a modified nucleic acid, particularly a modified RNA as defined herein can contain a lipid modification. Such a lipid-modified nucleic acid typically comprises a nucleic acid as defined herein. Such a lipid-modified nucleic acid or RNA as defined herein typically further comprises at least one linker covalently linked with that nucleic acid or RNA, and at least one lipid covalently linked with the respective linker. Alternatively, the lipid-modified nucleic acid comprises at least one nucleic acid as defined herein and at least one (bifunctional) lipid covalently linked (without a linker) with that nucleic acid. According to a third alternative, the lipid-modified nucleic acid comprises an nucleic acid molecule as defined herein, at least one linker covalently linked with that RNA, and at least one lipid covalently linked with the respective linker, and also at least one (bifunctional) lipid covalently linked (without a linker) with that nucleic acid. In this context, it is particularly preferred that the lipid modification is present at the terminal ends of a linear nucleic acid sequence.

Sequence Modified Henipavirus Sequences:

According to preferred embodiments, the artificial nucleic acid of the invention may be sequence-modified. Accordingly, in embodiments, the G/C content of the at least one coding sequence is increased compared to the G/C content of the corresponding wild type coding sequence, and/or the C content of the at least one coding sequence is increased compared to the C content of the corresponding wild type coding sequence and/or the codons in the at least one coding sequence are adapted to human codon usage, and/or the codon adaptation index (CAI) is preferably increased or maximised in the at least one coding sequence, wherein the amino acid sequence encoded by the at least one coding sequence is preferably not being modified compared to the amino acid sequence encoded by the corresponding wild type coding sequence.

According to a preferred embodiment, the present invention provides a nucleic acid sequence, encoding at least one antigenic peptide or protein derived from Henipavirus, wherein the at least one coding sequence comprises a (sequence modified) nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 53-234, 625-806, 859-1040, 1093-1274, 1275-1508, 1519-1539 or a fragment or variant of any of these sequences.

Sequence Modified Hendra Virus Sequences:

According to a preferred embodiment, the present invention provides a nucleic acid sequence, encoding at least one antigenic peptide or protein derived from Hendra virus, comprising at least one coding sequence, wherein the coding sequence comprises or consists of any one of the (modified) RNA sequences as defined in the columns "C-J" of Table 1 and Table 1B, or of a fragment or variant of any one of these sequences.

In a further preferred embodiment, the at least one coding sequence of the nucleic acid sequence, encoding at least one antigenic peptide or protein derived from Hendra virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (modified) RNA sequences as defined in columns "C-J" of Table 1 and Table 1B, or of a fragment or variant of any one of these sequences.

According to a particularly preferred embodiment, the at least one coding sequence of the nucleic acid sequence, encoding at least one antigenic peptide or protein derived from Hendra virus, comprises or consists of an RNA sequence having a sequence identity of at least 80% with any one of the (modified) RNA sequences as defined in the columns "C-J" of Table 1 and Table 1B, or of a fragment or variant of any one of these sequences.

Sequence Modified Nipah Virus Sequences:

According to a preferred embodiment, the present invention provides a nucleic acid sequence, encoding at least one antigenic peptide or protein derived from Nipah virus, comprising at least one coding sequence, wherein the coding sequence comprises or consists of any one of the (modified) RNA sequences as defined in the columns "C-J" of Table 2 and columns "C-J" of Table 2B, or of a fragment or variant of any one of these sequences.

In a further preferred embodiment, the at least one coding sequence of the nucleic acid sequence, encoding at least one antigenic peptide or protein derived from Nipah virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (modified) RNA sequences as defined in columns "C-J" of Table 2 and in columns "C-J" of Table 2B, or of a fragment or variant of any one of these sequences.

According to a particularly preferred embodiment, the at least one coding sequence of the nucleic acid sequence, encoding at least one antigenic peptide or protein derived from Nipah virus, comprises or consists of an RNA sequence having a sequence identity of at least 80% with any one of the (modified) RNA sequences according as defined in the columns "C-J" of Table 2 and in columns "C-J" of Table 2B, or of a fragment or variant of any one of these sequences.

G/C Content Modification:

According to an embodiment, the nucleic acid sequence of the present invention, may be modified, and thus stabilized, by modifying the guanosine/cytosine (G/C) content of the nucleic acid sequence, preferably of the at least one coding sequence of the nucleic acid sequence of the present invention.

In a particularly preferred embodiment of the present invention, the G/C content of the coding sequence of the nucleic acid sequence of the present invention is modified, particularly increased, compared to the G/C content of the coding sequence of the respective wild type nucleic acid sequence, i.e. the unmodified nucleic acid. The amino acid sequence encoded by the nucleic acid is preferably not modified as compared to the amino acid sequence encoded by the respective wild type nucleic acid. This modification of the nucleic acid sequence of the present invention is based on the fact that the sequence of any nucleic acid region, particularly the sequence of any RNA region to be translated is important for efficient translation of that nucleic acid, particularly of that RNA. Thus, the composition of the nucleic acid and the sequence of various nucleotides are important. In particular, in case of RNA, sequences having an increased G (guanosine)/C (cytosine) content are more stable than sequences having an increased A (adenosine)/U (uracil) content. According to the invention, the codons of the nucleic acid are therefore varied compared to the respective wild type nucleic acid, while retaining the translated amino acid sequence, such that they include an increased amount of G/C nucleotides. In respect to the fact that several codons code for one and the same amino acid (so-called degeneration of the genetic code), the most favourable codons for the stability can be determined (so-called alternative codon usage). Depending on the amino acid to be encoded by the nucleic acid, there are various possibilities for modification of the nucleic acid sequence, compared to its wild type sequence.

The following modifications may apply for RNA molecules, but may also be transferrable to DNA molecules: In the case of amino acids, which are encoded by codons, containing exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUC; the codons for Thr can be modified from ACU or ACA to ACC or ACG; the codon for Asn can be modified from AAU to AAC; the codon for Lys can be modified from AAA to AAG; the codons for Val can be modified from GUU or GUA to GUC or GUG; the codon for Asp can be modified from GAU to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the RNA sequence of the present invention compared to its particular wild type RNA (i.e. the original sequence). Thus, for example, all codons for Thr occurring in the wild type sequence can be modified to ACC (or ACG). Preferably, however, for example, combinations of the above substitution possibilities are used: substitution of all codons coding for Thr in the original sequence (wild type RNA) to ACC (or ACG) and substitution of all codons originally coding for Ser to UCC (or UCG or AGC); substitution of all codons coding for Ile in the original sequence to AUC and substitution of all codons originally coding for Lys to AAG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Gly to GGC (or GGG) and substitution of all codons originally coding for Asn to MC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc.

Preferably, the G/C content of the coding sequence of the RNA sequence of the present invention is increased by at least 7%, more preferably by at least 15%, particularly preferably by at least 20%, compared to the G/C content of the coding sequence of the wild type RNA, which codes for an NIPAH virus antigen as defined herein or a fragment or variant thereof. According to a specific embodiment at least 5%, 10%, 20%, 30%, 40%, 50%, 60%, more preferably at least 70%, even more preferably at least 80% and most preferably at least 90%, 95% or even 100% of the substitutable codons in the region coding for a peptide or protein as defined herein or a fragment or variant thereof or the whole sequence of the wild type RNA sequence are substituted, thereby increasing the GC/content of said sequence. In this context, it is particularly preferable to increase the G/C content of the RNA sequence of the present invention, preferably of the at least one coding sequence of the RNA sequence according to the invention, to the maximum (i.e. 100% of the substitutable codons) as compared to the wild type sequence. According to the invention, a further preferred modification of the RNA sequence of the present invention is based on the finding that the translation efficiency is also determined by a different frequency in the occurrence of tRNAs in cells. Thus, if so-called "rare codons" are present in the RNA sequence of the present invention to an increased extent, the corresponding modified RNA sequence is translated to a significantly poorer degree than in the case where codons coding for relatively "frequent" tRNAs are present. According to the invention, in the modified RNA sequence of the present invention, the region which codes for a peptide or protein as defined herein or a fragment or variant thereof is modified compared to the corresponding region of the wild type RNA sequence such that at least one codon of the wild type sequence, which codes for a tRNA which is relatively rare in the cell, is exchanged for a codon, which codes for a tRNA which is relatively frequent in the cell and carries the same amino acid as the relatively rare tRNA. By this modification, the sequence of the RNA of the present invention is modified such that codons for which frequently occurring tRNAs are available are inserted. In other words, according to the invention, by this modification all codons of the wild type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons, which use for the particular amino acid the tRNA which occurs the most frequently, e.g. the Gly codon, which uses the tRNA, which occurs the most frequently in the (human) cell, are particularly preferred. According to the invention, it is particularly preferable to link the sequential G/C content which is increased, in particular maximized, in the modified RNA sequence of the present invention, with the "frequent" codons without modifying the amino acid sequence of the protein encoded by the coding sequence of the RNA sequence. This preferred embodiment allows provision of a particularly efficiently translated and stabilized (modified) RNA sequence of the present invention. The determination of a modified RNA sequence of the present invention as described above (increased G/C content; exchange of tRNAs) can be carried out using the computer program explained in WO 02/098443—the disclosure content of which is included in its full scope in the present invention. Using this computer program, the nucleotide sequence of any desired RNA sequence can be modified with the aid of the genetic code or the degenerative nature thereof such that a maximum G/C content results, in combination with the use of codons which code for tRNAs occurring as frequently as possible in the cell, the amino acid sequence coded by the modified RNA sequence preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the RNA sequence of the present invention is increased compared to the A/U content in the environment of the ribosome binding site of its respective wild type RNA. This modification (an increased A/U content around the ribosome binding site) increases the efficiency of ribosome binding to the RNA. An effective binding of the ribosomes to the ribosome binding site (Kozak sequence: SEQ ID NO: 255, 256; the AUG forms the start codon) in turn has the effect of an efficient translation of the RNA. According to a further embodiment of the present invention, the RNA sequence of the present invention may be modified with respect to potentially destabilizing sequence elements. Particularly, the coding sequence and/or the 5' and/or 3' untranslated region of this RNA sequence may be modified compared to the respective wild type RNA such that it contains no destabilizing sequence elements, the encoded amino acid sequence of the modified RNA sequence preferably not being modified compared to its respective wild type RNA. It is known that, for example in sequences of eukaryotic RNAs, destabilizing sequence elements (DSE) occur, to which signal proteins bind and regulate enzymatic degradation of RNA in vivo. For further stabilization of the modified RNA sequence, optionally in the region which encodes at least one peptide or protein as defined herein or a fragment or variant thereof, one or more such modifications compared to the corresponding region of the wild type RNA can therefore be carried out, so that no or substantially no destabilizing sequence elements are contained there. According to the invention, DSE present in the untranslated regions (3'- and/or 5'-UTR) can also be eliminated from the RNA sequence of the present invention by such modifications. Such destabilizing sequences are e.g. AU-rich sequences (AURES), which occur in 3'-UTR sections of numerous unstable RNAs (Caput et al., Proc. Natl. Acad. Sci. USA 1986, 83: 1670 to 1674). The RNA sequence of the present invention is therefore preferably modified compared to the respective wild type RNA such that the RNA sequence of the present invention contains no such destabilizing sequences. This also applies to those sequence motifs which are recognized by possible endonucleases, e.g. the sequence GAACAAG, which is contained in the 3'-UTR segment of the gene encoding the transferrin receptor (Binder et al., EMBO J. 1994, 13: 1969 to 1980). These sequence motifs are also preferably removed in the RNA sequence of the present invention.

G/C Content Modified Henipavirus Sequences:

According to a preferred embodiment, the present invention provides a nucleic acid sequence, encoding at least one antigenic peptide or protein derived from Henipavirus, wherein the at least one coding sequence comprises a (G/C) modified) nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of any one of the (modified) RNA sequences as defined in the columns "C, G-J" (opt1, opt5, opt6, opt7) of Table 1, Table 1B, Table 2, and Table 2B.

According to a particularly preferred embodiment, the artificial nucleic acid according to the invention comprises at least one coding sequence, wherein the at least one coding sequence comprises a nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of 53-78, 625-635, 859-869, 1093-1103, 636-650, 870-884, 1104-1118, 1275-1508, 1519-1521 and as defined in columns "C" (opt1) of Table 1, Table 1B, Table 2, and Table 2B, or a fragment or variant of any of these sequences.

G/C Content Modified Hendra Virus Sequences:

According to a preferred embodiment, the present invention provides a nucleic acid sequence, encoding at least one antigenic peptide or protein derived from Hendra virus, comprising at least one coding sequence, wherein the coding sequence comprises or consists of any one of the (G/C modified) RNA sequences as defined in columns "C, G-J" (opt1, opt5, opt6, opt7) of Table 1 and columns "C, G-J" (opt1, opt5, opt6, opt7) of Table 1B, or of a fragment or variant of any one of these sequences.

According to a preferred embodiment, the present invention provides an nucleic acid sequence as defined herein comprising at least one coding sequence encoding at least one Hendra virus antigenic peptide or protein derived from Hendra virus fusion protein (F), wherein the coding sequence comprises or consists of any one of the (G/C modified) RNA sequences according to SEQ ID NOs: 60-63, 164-167, 190-193, 216-219, 632-635, 866-869, 1100-1103, 736-739, 970-973, 1204-1207, 762-765, 996-999, 1230-1233, 788-791, 1022-1025, 1256-1259 and as defined in columns "C, G-J" (opt1, opt5, opt6, opt7) of Table 1 and columns "C, G-J" (opt1, opt5, opt6, opt7) of Table 1B, or of a fragment or variant of any one of these sequences.

According to a preferred embodiment, the present invention provides an nucleic acid sequence as defined herein comprising at least one coding sequence encoding at least one Hendra virus antigenic peptide or protein derived from Hendra virus glycoprotein (G), wherein the coding sequence comprises or consists of any one of the (G/C modified) RNA sequences according to SEQ ID NOs: 71-78, 175-182, 201-208, 227-234, 643-650, 877-884, 1111-1118, 747-754, 981-988, 1215-1222, 773-780, 1007-1014, 1241-1248, 799-806, 1033-1040, 1267-1274 and as defined in columns "C, G-J" (opt1, opt5, opt6, opt7) of Table 1 and columns "C, G-J" (opt1, opt5, opt6, opt7) of Table 1B, or of a fragment or variant of any one of these sequences.

In a further preferred embodiment, the at least one coding sequence of the nucleic acid sequence, encoding at least one antigenic peptide or protein derived from Hendra virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (G/C modified) RNA sequences as defined in columns "C, G-J" (opt1, opt5, opt6, opt7) of Table 1 and columns "C, G-J" (opt1, opt5, opt6, opt7) of Table 1B, or of a fragment or variant of any one of these sequences.

According to a particularly preferred embodiment, the at least one coding sequence of the RNA sequence, encoding at least one antigenic peptide or protein derived from Hendra virus, comprises or consists of an nucleic acid sequence having a sequence identity of at least 80% with any one of the (G/C modified) RNA sequences according as defined in columns "C, G-J" ("opt1, opt5, opt6, opt7") of Table 1 and columns "C, G-J" (opt1, opt5, opt6, opt7) of Table 1B, or of a fragment or variant of any one of these sequences.

G/C Content Modified Nipah Virus Sequences:

According to a preferred embodiment, the present invention provides a nucleic acid sequence, encoding at least one antigenic peptide or protein derived from Nipah virus, comprising at least one coding sequence, wherein the coding sequence comprises or consists of any one of the (G/C modified) RNA sequences as defined in columns "C, G-J" (opt1, opt5, opt6, opt7) of Table 2 and columns "C, G-J" (opt1, opt5, opt6, opt7) of Table 2B, or of a fragment or variant of any one of these sequences.

According to a preferred embodiment, the present invention provides an nucleic acid sequence as defined herein comprising at least one coding sequence encoding at least one Nipah virus antigenic peptide or protein derived from Nipah virus fusion protein (F), wherein the coding sequence comprises or consists of any one of the (G/C modified) RNA sequences according to SEQ ID NOs: 53-59, 157-163, 183-189, 209-215, 625-631, 859-865, 1093-1099, 729-735, 963-969, 1197-1203, 755-761, 989-995, 1223-1229, 781-787, 1015-1021, 1249-1255, 1519-1521, 1531-1539 and as defined in columns "C, G-J" (opt1, opt5, opt6, opt7) of Table 2 and columns "C, G-J" (opt1, opt5, opt6, opt7) of Table 2B, or of a fragment or variant of any one of these sequences.

According to a preferred embodiment, the present invention provides an nucleic acid sequence as defined herein comprising at least one coding sequence encoding at least one Nipah virus antigenic peptide or protein derived from Nipah virus glycoprotein (G), wherein the coding sequence comprises or consists of any one of the (G/C modified) RNA sequences according to SEQ ID NOs: 64-70, 168-174, 194-200, 220-226, 636-642, 870-876, 1104-1110, 740-746, 974-980, 1208-1214, 766-772, 1000-1006, 1234-1240 and as defined in columns "C, G-J" (opt1, opt5, opt6, opt7) of Table 2 and columns "C, G-J" (opt1, opt5, opt6, opt7) of Table 2B, or of a fragment or variant of any one of these sequences.

In a further preferred embodiment, the at least one coding sequence of the nucleic acid sequence, encoding at least one antigenic peptide or protein derived from Nipah virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (G/C modified) RNA sequences as defined in columns "C, G-J" (opt1, opt5, opt6, opt7) of Table 2 and columns "C, G-J" (opt1, opt5, opt6, opt7) of Table 2B, or of a fragment or variant of any one of these sequences.

According to a particularly preferred embodiment, the at least one coding sequence of the RNA sequence, encoding at least one antigenic peptide or protein derived from Nipah virus, according to the invention comprises or consists of an nucleic acid sequence having a sequence identity of at least 80% with any one of the (G/C modified) RNA sequences as defined in columns "C, G-J" (opt1, opt5, opt6, opt7) of Table 2 and columns "C, G-J" (opt1, opt5, opt6, opt7) of Table 2B, or of a fragment or variant of any one of these sequences.

Sequence Adaptation to Human Codon Usage:

According to the invention, a further preferred modification of the nucleic acid sequence of the present invention is based on the finding that codons encoding the same amino acid typically occur at different frequencies. According to the invention, in the modified nucleic acid sequence of the present invention, the coding sequence as defined herein is preferably modified compared to the corresponding coding sequence of the respective wild type nucleic acid such that the frequency of the codons encoding the same amino acid corresponds to the naturally occurring frequency of that codon according to the human codon usage as e.g. shown in Table 4.

For example, in the case of the amino acid alanine (Ala) present in an amino acid sequence encoded by the at least one coding sequence of the a nucleic acid sequence according to the invention, the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 4).

TABLE 4

Human codon usage table

| Amino acid | codon | fraction | /1000 | Amino acid | codon | fraction | /1000 |
|---|---|---|---|---|---|---|---|
| Ala | GCG | 0.10 | 7.4 | Pro | CCG | 0.11 | 6.9 |
| Ala | GCA | 0.22 | 15.8 | Pro | CCA | 0.27 | 16.9 |
| Ala | GCT | 0.28 | 18.5 | Pro | CCT | 0.29 | 17.5 |
| Ala | GCC* | 0.40 | 27.7 | Pro | CCC* | 0.33 | 19.8 |
| Cys | TGT | 0.42 | 10.6 | Gln | CAG* | 0.73 | 34.2 |
| Cys | TGC* | 0.58 | 12.6 | Gln | CAA | 0.27 | 12.3 |
| Asp | GAT | 0.44 | 21.8 | Arg | AGG | 0.22 | 12.0 |
| Asp | GAC* | 0.56 | 25.1 | Arg | AGA* | 0.21 | 12.1 |
| Glu | GAG* | 0.59 | 39.6 | Arg | CGG | 0.19 | 11.4 |
| Glu | GAA | 0.41 | 29.0 | Arg | CGA | 0.10 | 6.2 |
| Phe | TTT | 0.43 | 17.6 | Arg | CGT | 0.09 | 4.5 |
| Phe | TTC* | 0.57 | 20.3 | Arg | CGC | 0.19 | 10.4 |
| Gly | GGG | 0.23 | 16.5 | Ser | AGT | 0.14 | 12.1 |
| Gly | GGA | 0.26 | 16.5 | Ser | AGC* | 0.25 | 19.5 |
| Gly | GGT | 0.18 | 10.8 | Ser | TCG | 0.06 | 4.4 |
| Gly | GGC* | 0.33 | 22.2 | Ser | TCA | 0.15 | 12.2 |
| His | CAT | 0.41 | 10.9 | Ser | TCT | 0.18 | 15.2 |
| His | CAC* | 0.59 | 15.1 | Ser | TCC | 0.23 | 17.7 |
| Ile | ATA | 0.14 | 7.5 | Thr | ACG | 0.12 | 6.1 |
| Ile | ATT | 0.35 | 16.0 | Thr | ACA | 0.27 | 15.1 |
| Ile | ATC* | 0.52 | 20.8 | Thr | ACT | 0.23 | 13.1 |
| Lys | AAG* | 0.60 | 31.9 | Thr | ACC* | 0.38 | 18.9 |
| Lys | AAA | 0.40 | 24.4 | Val | GTG* | 0.48 | 28.1 |
| Leu | TTG | 0.12 | 12.9 | Val | GTA | 0.10 | 7.1 |
| Leu | TTA | 0.06 | 7.7 | Val | GTT | 0.17 | 11.0 |
| Leu | CTG* | 0.43 | 39.6 | Val | GTC | 0.25 | 14.5 |
| Leu | CTA | 0.07 | 7.2 | Trp | TGG* | 1 | 13.2 |
| Leu | CTT | 0.12 | 13.2 | Tyr | TAT | 0.42 | 12.2 |
| Leu | CTC | 0.20 | 19.6 | Tyr | TAC* | 0.58 | 15.3 |
| Met | ATG* | 1 | 22.0 | Stop | TGA* | 0.61 | 1.6 |
| Asn | AAT | 0.44 | 17.0 | Stop | TAG | 0.17 | 0.8 |
| Asn | AAC* | 0.56 | 19.1 | Stop | TAA | 0.22 | 1.0 |

*most frequent codon

Human Codon Usage Adapted Hendra Virus Sequences:

According to a preferred embodiment, the present invention provides a nucleic acid sequence comprising at least one coding sequence, encoding at least one antigenic peptide or protein derived from Hendra virus, wherein the coding sequence comprises or consists of any one of the (human codon usage adapted) RNA sequences as defined in column "E" (opt3) of Table 1 and column "E" (opt3) of Table 1B, or of a fragment or variant of any one of these sequences.

According to a preferred embodiment, the present invention provides an nucleic acid sequence as defined herein comprising at least one coding sequence encoding at least one Hendra virus antigenic peptide or protein derived from Hendra virus fusion protein (F), wherein the coding sequence comprises or consists of any one of the (human codon usage adapted) RNA sequences according to SEQ ID NOs: 112-115, 684-687, 918-921, 1152-1155, and as defined in column "E" (opt3) of Table 1 and column "E" (opt3) of Table 1B, or of a fragment or variant of any one of these sequences.

According to a preferred embodiment, the present invention provides an nucleic acid sequence as defined herein comprising at least one coding sequence encoding at least one Hendra virus antigenic peptide or protein derived from Hendra virus glycoprotein (G), wherein the coding sequence comprises or consists of any one of the (human codon usage adapted) RNA sequences according to SEQ ID NOs: 123-130, 695-702, 929-936, 1163-1170 and as defined in column "E" (opt3) of Table 1 and column "E" (opt3) of Table 1B, or of a fragment or variant of any one of these sequences.

In a further preferred embodiment, the at least one coding sequence of the nucleic acid sequence, encoding at least one antigenic peptide or protein derived from Hendra virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (human codon usage adapted) RNA sequences as defined in column "E" (opt3) of Table 1 and column "E" (opt3) of Table 1B, or of a fragment or variant of any one of these sequences.

According to a particularly preferred embodiment, the at least one coding sequence of the RNA sequence, encoding at least one antigenic peptide or protein derived from Hendra virus, comprises or consists of an nucleic acid sequence having a sequence identity of at least 80% with any one of the (human codon usage adapted) RNA sequences as defined in column "E" (opt3) of Table 1 and column "E" (opt3) of Table 1B, or of a fragment or variant of any one of these sequences.

Human Codon Usage Adapted Nipah Virus Sequences:

According to a preferred embodiment, the present invention provides a nucleic acid sequence comprising at least one coding sequence, encoding at least one antigenic peptide or protein derived from Nipah virus, wherein the coding sequence comprises or consists of any one of the (human codon usage adapted) RNA sequences as defined in column "E" (opt3) of Table 2 and column "E" (opt3) of Table 2B, or of a fragment or variant of any one of these sequences.

According to a preferred embodiment, the present invention provides an nucleic acid sequence as defined herein comprising at least one coding sequence encoding at least one Nipah virus antigenic peptide or protein derived from Nipah virus fusion protein (F), wherein the coding sequence comprises or consists of any one of the (human codon usage adapted) RNA sequences according to SEQ ID NOs: 105-111, 677-683, 911-917, 1145-1151, 1525-1527 and as defined in column "E" (opt3) of Table 2 and column "E" (opt3) of Table 2B, or of a fragment or variant of any one of these sequences.

According to a preferred embodiment, the present invention provides an nucleic acid sequence as defined herein comprising at least one coding sequence encoding at least one Nipah virus antigenic peptide or protein derived from Nipah virus glycoprotein (G), wherein the coding sequence comprises or consists of any one of the (human codon usage adapted) RNA sequences according to SEQ ID NOs: 116-122, 688-694, 922-928, 1156-1162 and as defined in column "E" (opt3) of Table 2 and column "E" (opt3) of Table 2B, or of a fragment or variant of any one of these sequences.

In a further preferred embodiment, the at least one coding sequence of the nucleic acid sequence, encoding at least one antigenic peptide or protein derived from Nipah virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (human codon usage adapted) RNA sequences as defined in column "E" (opt3) of Table 2 and column "E" (opt3) of Table 2B, or of a fragment or variant of any one of these sequences.

According to a particularly preferred embodiment, the at least one coding sequence of the RNA sequence, encoding at least one antigenic peptide or protein derived from Nipah virus, comprises or consists of an nucleic acid sequence having a sequence identity of at least 80% with any one of the (human codon usage adapted) RNA sequences as defined in column "E" (opt3) of Table 2 and column "E" (opt3) of Table 2B, or of a fragment or variant of any one of these sequences.

Codon-Optimization (CAI Maximization):

As described above it is preferred according to the invention, that all codons of the wild type sequence which code for a tRNA, which is relatively rare in the cell, are exchanged for a codon which codes for a tRNA, which is relatively frequent in the cell and which, in each case, carries the same amino acid as the relatively rare tRNA. Therefore it is particularly preferred that the most frequent codons are used for each encoded amino acid (see Table 4, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences. According to a preferred embodiment, the nucleic acid sequence of the present invention comprises at least one coding sequence, wherein the coding sequence/sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the nucleic acid sequence according to the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

Codon Optimized Hendra Virus Sequences:

According to a preferred embodiment, the present invention provides a nucleic acid sequence comprising at least one coding sequence, encoding at least one antigenic peptide or protein derived from Hendra virus, wherein the coding sequence comprises or consists of any one of the (codon optimized) RNA sequences as defined in column "F" (opt4) of Table 1 and column "F" (opt4) of Table 1B, or of a fragment or variant of any one of these sequences.

According to a preferred embodiment, the present invention provides an nucleic acid sequence as defined herein comprising at least one coding sequence encoding at least one Hendra virus antigenic peptide or protein derived from Hendra virus fusion protein (F), wherein the coding sequence comprises or consists of any one of the (codon optimized) RNA sequences according to SEQ ID NOs: 138-141, 710-713, 944-947, 1178-1181 and as defined in columns "F" ("opt4") of Table 1 and columns "F" ("opt4") of Table 1B, or of a fragment or variant of any one of these sequences.

According to a preferred embodiment, the present invention provides an nucleic acid sequence as defined herein comprising at least one coding sequence encoding at least one Hendra virus antigenic peptide or protein derived from Hendra virus glycoprotein (G), wherein the coding sequence comprises or consists of any one of the (codon optimized) RNA sequences according to SEQ ID NOs: 149-156, 721-728, 955-962, 1189-1196 and as defined in columns "F" ("opt4") of Table 1 and columns "F" ("opt4") of Table 1B, or of a fragment or variant of any one of these sequences.

In a further preferred embodiment, the at least one coding sequence of the nucleic acid sequence, encoding at least one antigenic peptide or protein derived from Hendra virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (codon optimized) RNA sequences as defined in column "F" (opt4) of Table 1 and column "F" (opt4) of Table 1B, or of a fragment or variant of any one of these sequences.

According to a particularly preferred embodiment, the at least one coding sequence of the RNA sequence, encoding at least one antigenic peptide or protein derived from Hendra virus, comprises or consists of an nucleic acid sequence having a sequence identity of at least 80% with any one of the (codon optimized) RNA sequences as defined in column "F" (opt4) of Table 1 and column "F" (opt4) of Table 1B, or of a fragment or variant of any one of these sequences.

Codon Optimized Nipah Virus Sequences:

According to a preferred embodiment, the present invention provides a nucleic acid sequence comprising at least one coding sequence, encoding at least one antigenic peptide or protein derived from Nipah virus, wherein the coding sequence comprises or consists of any one of the (codon optimized) RNA sequences as defined in column "F" (opt4) of Table 2 and column "F" (opt4) of Table 2B, or of a fragment or variant of any one of these sequences.

According to a preferred embodiment, the present invention provides an nucleic acid sequence as defined herein comprising at least one coding sequence encoding at least one Nipah virus antigenic peptide or protein derived from Nipah virus fusion protein (F), wherein the coding sequence comprises or consists of any one of the (codon optimized) RNA sequences according to SEQ ID NOs: 131-137, 703-709, 937-943, 1171-1177, 1528-1530 and as defined in column "F" (opt4) of Table 2 and column "F" (opt4) of Table 2B, or of a fragment or variant of any one of these sequences.

According to a preferred embodiment, the present invention provides an nucleic acid sequence as defined herein comprising at least one coding sequence encoding at least one Nipah virus antigenic peptide or protein derived from Nipah virus glycoprotein (G), wherein the coding sequence comprises or consists of any one of the (codon optimized) RNA sequences according to SEQ ID NOs: 142-148, 714-720, 948-954, 1182-1188 and as defined in column "F" (opt4) of Table 2 and column "F" (opt4) of Table 2B, or of a fragment or variant of any one of these sequences.

In a further preferred embodiment, the at least one coding sequence of the nucleic acid sequence, encoding at least one antigenic peptide or protein derived from Nipah virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (codon optimized) RNA sequences according as defined in column "F" (opt4) of Table 2 and column "F" (opt4) of Table 2B, or of a fragment or variant of any one of these sequences.

According to a particularly preferred embodiment, the at least one coding sequence of the RNA sequence, encoding at least one antigenic peptide or protein derived from Nipah virus, comprises or consists of an nucleic acid sequence having a sequence identity of at least 80% with any one of the (codon optimized) RNA sequences as defined in column "F" (opt4) of Table 2 and column "F" (opt4) of Table 2B, or of a fragment or variant of any one of these sequences.

Cytosine Optimization:

According to another embodiment, the nucleic acid sequence of the present invention may be modified by modifying, preferably increasing, the cytosine (C) content of the nucleic acid sequence, preferably of the coding sequence of the nucleic acid sequence, more preferably the coding sequence of the RNA sequence.

In a particularly preferred embodiment of the present invention, the C content of the coding sequence of the nucleic acid sequence of the present invention is modified, preferably increased, compared to the C content of the coding sequence of the respective wild type nucleic acid, i.e. the unmodified nucleic acid. The amino acid sequence encoded by the at least one coding sequence of the nucleic acid sequence of the present invention is preferably not modified as compared to the amino acid sequence encoded by the respective wild type nucleic acid.

In a preferred embodiment of the present invention, the modified nucleic acid, particularly the modified RNA sequence is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the target nucleic acid, particularly the modified RNA wild type sequence, which are "cytosine content optimizable" are replaced by codons having a higher cytosine-content than the ones present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In a further preferred embodiment of the present invention, the modified target nucleic acid, preferably the RNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term "cytosine content-optimizable codon" as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding sequence increases its overall C-content and reflects a C-enriched modified nucleic acid sequence. According to a preferred embodiment, the nucleic acid sequence, particularly the RNA sequence of the present invention, preferably the at least one coding sequence of the nucleic acid sequence of the present invention comprises or consists of a C-maximized RNA sequence containing C-optimized codons for all potentially C-optimizable codons. Accordingly, 100% or all of the theoretically replaceable C-optimizable codons are preferably replaced by C-optimized codons over the entire length of the coding sequence.

In this context, cytosine-content optimizable codons are codons, which contain a lower number of cytosines than other codons coding for the same amino acid. Any of the codons GCG, GCA, GCU codes for the amino acid Ala, which may be exchanged by the codon GCC encoding the same amino acid, and/or the codon UGU that codes for Cys may be exchanged by the codon UGC encoding the same amino acid, and/or the codon GAU which codes for Asp may be exchanged by the codon GAC encoding the same amino acid, and/or the codon that UUU that codes for Phe may be exchanged for the codon UUC encoding the same amino acid, and/or any of the codons GGG, GGA, GGU that code Gly may be exchanged by the codon GGC encoding the same amino acid, and/or the codon CAU that codes for His may be exchanged by the codon CAC encoding the same amino acid, and/or any of the codons AUA, AUU that code for Ile may be exchanged by the codon AUC, and/or any of the codons UUG, UUA, CUG, CUA, CUU coding for Leu may be exchanged by the codon CUC encoding the same amino acid, and/or the codon AAU that codes for Asn may be exchanged by the codon AAC encoding the same amino acid, and/or any of the codons CCG, CCA, CCU coding for Pro may be exchanged by the codon CCC encoding the same amino acid, and/or any of the codons AGG, AGA, CGG, CGA, CGU coding for Arg may be exchanged by the codon CGC encoding the same amino acid, and/or any of the codons AGU, AGC, UCG, UCA, UCU coding for Ser may be exchanged by the codon UCC encoding the same amino acid, and/or any of the codons ACG, ACA, ACU coding for Thr may be exchanged by the codon ACC encoding the same amino acid, and/or any of the codons GUG, GUA, GUU coding for Val may be exchanged by the codon GUC encoding the same amino acid, and/or the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding sequence results in a C-maximized coding sequence. In the context of the invention, at least 70%, preferably at least 80%, more preferably at least 90%, of the non C-optimized codons within the at least one coding sequence of the RNA sequence according to the invention are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding sequence.

Preferably, in a C-optimized RNA sequence of the invention, at least 50% of the C-optimizable wild type codons for any given amino acid are replaced by C-optimized codons, e.g. any modified C-enriched RNA sequence preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GAA coding for Glu may be exchanged by the relative frequent codon GAG coding for the same amino acid, and/or the relatively rare codon AAA coding for Lys may be exchanged by the relative frequent codon AAG coding for the same amino acid, and/or the relatively rare codon CAA coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (UGA).

The single substitutions listed above may be used individually as well as in all possible combinations in order to optimize the cytosine-content of the modified nucleic acid sequence compared to the wild type nucleic acid sequence.

Accordingly, the at least one coding sequence as defined herein may be changed compared to the coding sequence of the respective wild type nucleic acid in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

C-Optimized Hendra Virus Sequences:

According to a preferred embodiment, the present invention provides a nucleic acid sequence comprising at least one coding sequence, encoding at least one antigenic peptide or protein derived from Hendra virus, wherein the coding sequence comprises or consists of any one of the (C-optimized) RNA sequences as defined in column "D" ("opt2") of Table 1 and in column "D" (opt2) of Table 1B, or of a fragment or variant of any one of these sequences.

According to a preferred embodiment, the present invention provides an nucleic acid sequence as defined herein comprising at least one coding sequence encoding at least one Hendra virus antigenic peptide or protein derived from Hendra virus fusion protein (F), wherein the coding sequence comprises or consists of any one of the (C-optimized) RNA sequences according to SEQ ID NOs: 86-89, 658-661, 892-895, 1126-1129 and as defined in column "D" ("opt2") of Table 1 and in column "D" (opt2) of Table 1B, or of a fragment or variant of any one of these sequences.

According to a preferred embodiment, the present invention provides an nucleic acid sequence as defined herein comprising at least one coding sequence encoding at least one Hendra virus antigenic peptide or protein derived from Hendra virus glycoprotein (G), wherein the coding sequence comprises or consists of any one of the (C-optimized) RNA sequences according to SEQ ID NOs: 97-104, 669-676, 903-910, 1137-1144 and as defined in column "D" ("opt2") of Table 1 and in column "D" (opt2) of Table 1B, or of a fragment or variant of any one of these sequences.

In a further preferred embodiment, the at least one coding sequence of the nucleic acid sequence, encoding at least one antigenic peptide or protein derived from Hendra virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (C-optimized) RNA sequences as defined in column "D" ("opt2") of Table 1 and in column "D" (opt2) of Table 1B, or of a fragment or variant of any one of these sequences.

According to a particularly preferred embodiment, the at least one coding sequence of the RNA sequence, encoding at least one antigenic peptide or protein derived from Hendra virus, comprises or consists of an nucleic acid sequence having a sequence identity of at least 80% with any one of the (C-optimized) RNA sequences as defined in column "D" ("opt2") of Table 1 and in column "D" (opt2) of Table 1B, or of a fragment or variant of any one of these sequences.

C-Optimized Nipah Virus Sequences:

According to a preferred embodiment, the present invention provides a nucleic acid sequence comprising at least one coding sequence, encoding at least one antigenic peptide or protein derived from Nipah virus, wherein the coding sequence comprises or consists of any one of the (C-optimized) RNA sequences as defined in column "D" (opt2) of Table 2 and in column "D" (opt2) of Table 2B, or of a fragment or variant of any one of these sequences.

According to a preferred embodiment, the present invention provides an nucleic acid sequence as defined herein comprising at least one coding sequence encoding at least one Nipah virus antigenic peptide or protein derived from Nipah virus fusion protein (F), wherein the coding sequence comprises or consists of any one of the (C-optimized) RNA sequences according to SEQ ID NOs: 79-85, 651-657, 885-891, 1119-1125, 1522-1524 and as defined in column "D" (opt2) of Table 2 and in column "D" (opt2) of Table 2B, or of a fragment or variant of any one of these sequences.

According to a preferred embodiment, the present invention provides an nucleic acid sequence as defined herein comprising at least one coding sequence encoding at least one Nipah virus antigenic peptide or protein derived from Nipah virus glycoprotein (G), wherein the coding sequence comprises or consists of any one of the (C-optimized) RNA sequences according to SEQ ID NOs: 90-96, 662-668, 896-902, 1130-1136 and as defined in column "D" (opt2) of Table 2 and in column "D" (opt2) of Table 2B, or of a fragment or variant of any one of these sequences.

In a further preferred embodiment, the at least one coding sequence of the nucleic acid sequence, encoding at least one antigenic peptide or protein derived from Nipah virus, comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (C-optimized) RNA sequences as defined in column "D" (opt2) of Table 2 and in column "D" (opt2) of Table 2B, or of a fragment or variant of any one of these sequences.

According to a particularly preferred embodiment, the at least one coding sequence of the RNA sequence, encoding at least one antigenic peptide or protein derived from Nipah virus, comprises or consists of an nucleic acid sequence having a sequence identity of at least 80% with any one of the (C-optimized) RNA sequences as defined in column "D" (opt2) of Table 2 and in column "D" (opt2) of Table 2B, or of a fragment or variant of any one of these sequences.

Sequence Modified Secretory Signal Peptides:

According to a preferred embodiment, the present invention provides a nucleic acid sequence comprising at least one coding sequence, encoding at least one antigenic peptide or protein derived from Hendra virus and/or Nipah virus, and, additionally, an N-terminal secretory signal peptide, wherein the coding sequence comprises or consists of any one of the (modified) RNA sequences as defined in the columns "C-J" of Table 3, or of a fragment or variant of any one of these sequences.

In a further preferred embodiment, the at least one coding sequence of the nucleic acid sequence, encoding at least one antigenic peptide or protein derived from Hendra virus and/or Nipah virus, and, additionally, an N-terminal secretory signal peptide, wherein the coding sequence comprises or consists of an nucleic acid sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (modified) RNA sequences as defined in the columns "C-J" of Table 3, or of a fragment or variant of any one of these sequences.

According to a particularly preferred embodiment, the at least one coding sequence of the nucleic acid sequence comprises or consists of an RNA sequence having a sequence identity of at least 80% with any one of the (modified) RNA sequences as defined in the columns "C-J" of Table 3, or of a fragment or variant of any one of these sequences.

According to preferred embodiments, the present invention provides a nucleic acid sequence, wherein the at least one coding sequence comprises a (G/C modified) nucleic acid sequence, which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of any one of the (modified) RNA sequences as defined in the columns "C, G-J" (opt1, opt5, opt6, opt7) of Table 3.

5'-Cap Structure:

According to another preferred embodiment of the invention, a modified nucleic acid sequence as defined herein, particularly a modified RNA as defined herein can be modified by the addition of a so-called "5'-cap" structure, which preferably stabilizes the nucleic acid as described herein. A 5'-cap is an entity, typically a modified nucleotide entity, which generally "caps" the 5'-end of a mature RNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. m7GpppN is the 5'-cap structure, which naturally occurs in RNA transcribed by polymerase II and is therefore preferably not considered as modification comprised in a modified RNA in this context. Accordingly, a modified RNA sequence of the present invention may comprise a m7GpppN as 5'-cap, but additionally the modified RNA sequence typically comprises at least one further modification as defined herein.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3% 2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine. Accordingly, the RNA according to the invention preferably comprises a 5'-cap structure.

In a preferred embodiment, the 5'-cap structure is added co-transcriptionally using cap-analogues as defined herein in an RNA in vitro transcription reaction as defined herein. In another embodiment, the 5'-cap structure is added via enzymatic capping using capping enzymes (e.g. vaccinia virus capping enzymes). In another embodiment, the 5'-cap structure is added via enzymatic capping using immobilized capping enzymes, e.g. in a capping reactor (WO 2016/193226).

Accordingly, in preferred embodiments, the artificial nucleic acid of the invention comprises a 5'-cap structure as defined herein.

Poly(A) Sequence/Tail:

According to a further preferred embodiment, the nucleic acid sequence, particularly the RNA sequence of the present invention may contain a poly-A tail on the 3'-terminus of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the RNA sequence of the present invention is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the RNA according to the present invention using commercially available polyadenylation kits and corresponding protocols known in the art, or using immobilized poly(A)polymerases e.g. in a polyadenylation reactor (WO/2016/174271)

Alternatively, the RNA as described herein optionally comprises a polyadenylation signal, which is defined herein as a signal, which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(C) Sequence:

According to a further preferred embodiment, the nucleic acid sequence, particularly the RNA sequence of the present invention may contain a poly(C) tail on the 3'-terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides. Preferably, the poly(C) sequence in the RNA sequence of the present invention is derived from a DNA template by RNA in vitro transcription.

UTRs:

In a preferred embodiment, the artificial nucleic acid of the invention comprises at least one untranslated region (UTR.

In a preferred embodiment, the nucleic acid sequence, particularly the RNA sequence according to the invention comprises at least one 5'- and/or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably, the 5'- or 3'-UTR element used according to the present invention is heterologous to the at least one coding sequence of the RNA sequence of the invention. Even if 5'- or 3'-UTR elements derived from naturally occurring genes are preferred, also synthetically engineered UTR elements may be used in the context of the present invention.

3'-UTR Elements:

In preferred embodiment, the artificial nucleic acid of the invention comprises at least one 3'-UTR.

In a particularly preferred embodiment, the artificial nucleic acid of the invention comprises at least one heterologous 3'-UTR.

Preferably, the 3'-UTR comprises a poly(A) sequence and/or a poly(C) sequence as defined above, wherein the poly(A) sequence comprises 10 to 200, 10 to 100, 40 to 200, 40 to 80 or 50 to 70 adenosine nucleotides, and/or the poly(C) sequence comprises 10 to 200, 10 to 100, 20 to 70, 20 to 60 or 10 to 40 cytosine nucleotides.

The term "3'-UTR element" typically refers to a nucleic acid sequence, which comprises or consists of a nucleic acid sequence that is derived from a 3'-UTR or from a variant of a 3'-UTR. A 3'-UTR element in the sense of the present invention may represent the 3'-UTR of a nucleic acid molecule, particularly of an RNA or DNA, preferably an mRNA. Thus, in the sense of the present invention, preferably, a 3'-UTR element may be the 3'-UTR of an RNA, preferably of an mRNA, or it may be the transcription template for a 3'-UTR of an RNA. Thus, a 3'-UTR element preferably is a nucleic acid sequence which corresponds to the 3'-UTR of an RNA, preferably to the 3'-UTR of an mRNA, such as an mRNA obtained by transcription of a genetically engineered vector construct. Preferably, the 3'-UTR element fulfils the function of a 3'-UTR or encodes a sequence which fulfils the function of a 3'-UTR.

Preferably, the at least one 3'-UTR element comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the nucleic acid sequence, particularly the RNA sequence of the present invention comprises a 3'-UTR element, which may be derivable from a gene that relates to an RNA with an enhanced half-life (that provides a stable RNA), for example a 3'-UTR element as defined and described below. Preferably, the 3'-UTR element is a nucleic acid sequence derived from a 3' UTR of a gene, which preferably encodes a stable RNA, or from a homolog, a fragment or a variant of said gene.

In a particularly preferred embodiment, the 3'-UTR element comprises or consists of a nucleic acid sequence, which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(1) gene, or from a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(1) gene according to SEQ ID NOs: 1369-1390 of the patent application WO2013/143700, whose disclosure is incorporated herein by reference, or from a homolog, a fragment or a variant thereof. In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene according to SEQ ID NOs: 247, 249, 251 or the corresponding RNA sequence SEQ ID NOs: 248, 250, 252.

In this context it is particularly preferred that the RNA sequence according to the invention comprises a 3'-UTR element comprising a corresponding RNA sequence derived from the nucleic acids according to SEQ ID NOs: 1369-1390 of the patent application WO2013/143700 or a fragment, homolog or variant thereof.

Most preferably the 3'-UTR element comprises the nucleic acid sequence derived from a fragment of the human albumin gene according to SEQ ID NOs: 249-252.

In this context, it is particularly preferred that the 3'-UTR element of the RNA sequence according to the present invention comprises or consists of a corresponding RNA sequence of the nucleic acid sequence according to SEQ ID NOs: 249 or 251 as shown in SEQ ID NOs: 250 or 252.

In another particularly preferred embodiment, the 3'-UTR element comprises or consists of a nucleic acid sequence which is derived from a 3'-UTR of an alpha- or beta-globin gene, preferably a vertebrate alpha- or beta-globin gene, more preferably a mammalian alpha- or beta-globin gene, most preferably a human alpha- or beta-globin gene according to SEQ ID NOs: 239, 241, 243, 245 or the corresponding RNA sequences SEQ ID NOs: 240, 242, 244, 246.

For example, the 3'-UTR element may comprise or consist of the center, α-complex-binding portion of the 3'-UTR of an α-globin gene, such as of a human α-globin gene, or a homolog, a fragment, or a variant of an α-globin gene, preferably according to SEQ ID NO: 245 or 246.

In this context it is particularly preferred that the 3'-UTR element of the RNA sequence according to the invention comprises or consists of a corresponding RNA sequence of the nucleic acid sequence according to SEQ ID NO: 245 as shown in SEQ ID NO: 246, or a homolog, a fragment or variant thereof.

The term "a nucleic acid sequence which is derived from the 3'-UTR of a [ . . . ] gene" preferably refers to a nucleic acid sequence which is based on the 3'-UTR sequence of a [ . . . ] gene or on a part thereof, such as on the 3'-UTR of an albumin gene, an alpha-globin gene, a beta-globin gene, a tyrosine hydroxylase gene, a lipoxygenase gene, or a collagen alpha gene, such as a collagen alpha 1(1) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, alpha-globin gene, beta-globin gene, tyrosine hydroxylase gene, lipoxygenase gene, or collagen alpha gene, such as a collagen alpha 1(1) gene, preferably of an albumin gene.

The term "a nucleic acid sequence which is derived from a variant of the 3'-UTR of a [ . . . ] gene" preferably refers to a nucleic acid sequence, which is based on a variant of the 3'-UTR sequence of a gene, such as on a variant of the 3'-UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

In further embodiments, the artificial nucleic acid as defined herein, particularly the RNA as defined herein comprises a 3'-UTR element, which may be any 3'-UTR element described in WO2016/107877. In this context, the disclosure of WO2016/107877 relating to 3'-UTR elements/sequences is herewith incorporated by reference. Particularly preferred 3'-UTR elements are SEQ ID NOs: 1 to 24 and SEQ ID NOs: 49 to 318 of the patent application WO2016/107877, or fragments or variants of these sequences. In this context, it is particularly preferred that the 3'-UTR element of the RNA sequence according to the present invention comprises or consists of a corresponding RNA sequence of the nucleic acid sequence according SEQ ID NOs: 1 to 24 and SEQ ID NOs: 49 to 318 of the patent application WO2016/107877.

In embodiments, the artificial nucleic acid as defined herein, particularly the RNA as defined herein comprises a 3'-UTR element, which may be any 3'-UTR element as described in WO2017/036580. In this context, the disclosure of WO2017/036580 relating to 3'-UTR elements/sequences is herewith incorporated by reference. Particularly preferred 3'-UTR elements are nucleic acid sequences according to SEQ ID NOs: 152 to 204 of the patent application WO2017/036580, or fragments or variants of these sequences. In this context, it is particularly preferred that the 3'-UTR element of the RNA sequence according to the present invention comprises or consists of a corresponding RNA sequence of the nucleic acid sequence according SEQ ID NOs: 152 to 204 of the patent application WO2017/036580.

According to a preferred embodiment, the nucleic acid sequence, particularly the RNA sequence according to the invention comprises a 5'-cap structure and/or at least one 3'-untranslated region element (3'-UTR element), preferably as defined herein. More preferably, the RNA further comprises a 5'-UTR element as defined herein.

In a preferred embodiment the RNA sequence comprises, preferably in 5'- to 3'-direction:
a.) a 5'-cap structure, preferably m7GpppN;
b1.) optionally, at least one coding sequence encoding at least one heterologous secretory signal sequence;
b2.) at least one coding sequence encoding at least one antigenic peptide or protein derived from a Henipavirus, or a fragment or variant thereof,
c.) a 3'-UTR element comprising or consisting of a nucleic acid sequence which is derived from an alpha globin gene, preferably comprising the corresponding RNA sequence of the nucleic acid sequence according to SEQ ID NO: 246, a homolog, a fragment or a variant thereof;

d.) optionally, a poly(A) sequence, preferably comprising 64 adenosines;

e.) optionally, a poly(C) sequence, preferably comprising 30 cytosines;

In a particularly preferred embodiment the RNA sequence comprises, preferably in 5'- to 3'-direction:

a.) a 5'-cap structure, preferably m7GpppN;

b1.) optionally, at least one coding sequence encoding at least one heterologous secretory signal sequence, preferably selected from SEQ ID NOs 317-572;

b2.) at least one coding sequence encoding at least one antigenic peptide or protein derived from a Hendra virus protein or peptide or a fragment or variant thereof, preferably comprising or consisting of any one of the nucleic acid sequences according to SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274, or a fragment or variant thereof;

c.) a 3'-UTR element comprising or consisting of a nucleic acid sequence which is derived from an alpha globin gene, preferably comprising the corresponding RNA sequence of the nucleic acid sequence according to SEQ ID NO: 246, a homolog, a fragment or a variant thereof;
d.) optionally, a poly(A) sequence, preferably comprising 64 adenosines;
e.) optionally, a poly(C) sequence, preferably comprising 30 cytosines;

In a further particularly preferred embodiment the RNA sequence comprises, preferably in 5'- to 3'-direction:
a) a 5'-cap structure, preferably m7GpppN;
b1.) optionally, at least one coding sequence encoding at least one heterologous secretory signal sequence, preferably selected from SEQ ID NOs 317-572;
b2.) at least one coding sequence encoding at least one antigenic peptide or protein derived from a Nipah virus protein or peptide or a fragment or variant thereof, preferably comprising or consisting of any one of the nucleic acid sequences according to SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1516-1539 or a fragment or variant thereof;

c.) a 3'-UTR element comprising or consisting of a nucleic acid sequence which is derived from an alpha globin gene, preferably comprising the corresponding RNA sequence of the nucleic acid sequence according to SEQ ID NO: 246, a homolog, a fragment or a variant thereof;

d.) optionally, a poly(A) sequence, preferably comprising 64 adenosines;

e.) optionally, a poly(C) sequence, preferably comprising 30 cytosines;

5'-UTR Elements:

In a particularly preferred embodiment, the at least one nucleic acid sequence, in particular, the RNA sequence comprises at least one 5'-untranslated region element (5'-UTR element). Preferably, the at least one 5'-UTR element comprises or consists of a nucleic acid sequence, which is derived from the 5'-UTR of a TOP gene or which is derived from a fragment, homolog or variant of the 5'-UTR of a TOP gene.

It is particularly preferred that the 5'-UTR element does not comprise a TOP-motif or a 5'-TOP, as defined above.

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or RNA it is derived from. Thus, the 5'-UTR element does not comprise any part of the protein coding sequence. Thus, preferably, the only protein coding part of the at least one nucleic acid sequence, particularly of the RNA sequence, is provided by the coding sequence.

The nucleic acid sequence derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than *Homo sapiens*, which are homologous to the sequences according to SEQ ID NOs: 1-1363, SEQ ID NO: 1395, SEQ ID NO. 1421 and SEQ ID NO: 1422 of the patent application WO2013/143700.

In a preferred embodiment, the 5'-UTR element of the nucleic acid sequence, particularly of the RNA sequence according to the invention comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5'-UTR element is derived from a nucleic acid sequence extending from the nucleotide position immediately 3' to the 5'-TOP to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'-TOP motif. As described above, the sequence extending from position 5 to the nucleotide immediately 5' to the ATG (which is located at the 3'-end of the sequences) corresponds to the 5'-UTR of said sequences.

Preferably, the 5'-UTR element comprises or consists of a nucleic acid sequence, which is derived from a 5"-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'-TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'-TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3529 or 3530 (5'-UTR of human ribosomal protein Large 32 lacking the 5'-terminal oligopyrimidine tract: GGCGCTGCCTACGGAGGTGGCAGC-CATCTCCTTCTCGGCATC; corresponding to SEQ ID No. 1368 of the patent application WO2013/143700) or preferably to a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 235 or more preferably to a corresponding RNA sequence (SEQ ID NO: 236), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the RNA sequence according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the 5'-TOP of said genes, and wherein optionally the 5'-UTR element starts at its 5'-end with a nucleotide located at position 1, 2, 3, 4, 5, 6, 7, 8, 9 or 10 downstream of the 5'-terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit Vic gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit Vic gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit Vic gene (COX6C), or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit Vic gene (COX6C), or a human N-acylsphingosine amidohydrolase (acid ceramidase) 1 gene (ASAH1) or from a variant thereof, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NOs: 1412-1420 of the patent application WO2013/143700, or a corresponding RNA sequence or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according SEQ ID NOs: 1412-1420 of the patent application WO2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NOs: 237 or 238 (5'-UTR of ATP5A1 lacking the 5'-terminal oligopyrimidine tract: GCGGCTCGGCCAT-TTTGTCCCAGTCAGTCCG-GAGGCTGCGGCTGCAGAAGTACCGCCTGCG-GAGTAAC TGCAAAG; corresponding to SEQ ID NO: 1414 of the patent application WO2013/143700) or preferably to a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 237 or more preferably to a corresponding RNA sequence (SEQ ID NO: 238), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In embodiments, the artificial nucleic acid as defined herein, particularly the RNA as defined herein comprises a 5'-UTR element, which may be any 5'-UTR element described in WO2016/107877. In this context, the disclosure of WO2016/107877 relating to 5'-UTR elements/sequences is herewith incorporated by reference. Particularly preferred 5'-UTR elements are nucleic acid sequences according to SEQ ID NOs: 25 to 30 and SEQ ID NOs: 319 to 382 of the patent application WO2016/107877, or fragments or variants of these sequences. In this context, it is particularly preferred that the 5'-UTR element of the RNA sequence according to the present invention comprises or consists of a corresponding RNA sequence of the nucleic acid sequence according SEQ ID NOs: 25 to 30 and SEQ ID NOs: 319 to 382 of the patent application WO2016/107877.

In embodiments, the artificial nucleic acid sequence as defined herein, particularly the RNA as defined herein comprises a 5'-UTR element, which may be any 5'-UTR element as described in WO2017/036580. In this context, the disclosure of WO2017/036580 relating to 5'-UTR elements/sequences is herewith incorporated by reference. Particularly preferred 5'-UTR elements are nucleic acid sequences according to SEQ ID NOs: 1 to 151 of the patent application WO2017/036580, or fragments or variants of these sequences. In this context, it is particularly preferred that the 5'-UTR element of the RNA sequence according to the present invention comprises or consists of a corresponding RNA sequence of the nucleic acid sequence according to SEQ ID NOs: 1 to 151 of the patent application WO2017/036580.

Preferably, the at least one 5'-UTR element and the at least one 3'-UTR element act synergistically to increase protein production from the at least one RNA sequence as described above.

According to a preferred embodiment the RNA sequence according to the invention comprises, preferably in 5''- to 3'-direction:

a.) a 5'-cap structure, preferably m7GpppN;
b.) a 5'-UTR element which comprises or consists of a nucleic acid sequence which is derived from the 5'-UTR of a TOP gene (SEQ ID NOs: 235-238), a homolog, a fragment or a variant thereof;
c1.) optionally, at least one coding sequence encoding at least one heterologous secretory signal sequence;
c2.) at least one coding sequence encoding at least one antigenic peptide or protein derived from a Henipavirus protein or peptide as defined herein or a fragment or variant thereof.
d.) a 3'-UTR element comprising or consisting of a nucleic acid sequence which is derived from a gene providing a stable RNA, preferably comprising or consisting of the corresponding RNA sequence of a nucleic acid sequence according to SEQ ID NOs: 250 or 252, a homolog, a fragment or a variant thereof;

e.) optionally, a poly(A) sequence preferably comprising 64 adenosines; and f.) optionally, a poly(C) sequence, preferably comprising 30 cytosines.

According to a particularly preferred embodiment the RNA sequence according to the invention comprises, preferably in 5'- to 3'-direction:

a.) a 5'-cap structure, preferably m7GpppN;

b.) a 5'-UTR element which comprises or consists of a nucleic acid sequence which is derived from the 5'-UTR of a TOP gene (SEQ ID NOs: 235-238), a homolog, a fragment or a variant thereof;

c1.) optionally, at least one coding sequence encoding at least one heterologous secretory signal sequence, preferably selected from SEQ ID NOs 317-572;

c2.) at least one coding sequence encoding at least one antigenic peptide or protein derived from a Hendra virus protein or peptide or a fragment or variant thereof, preferably comprising or consisting of any one of the nucleic acid sequences according to SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-

999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274, or a fragment or variant thereof;
d.) a 3'-UTR element comprising or consisting of a nucleic acid sequence which is derived from a gene providing a stable RNA, preferably comprising or consisting of the corresponding RNA sequence of a nucleic acid sequence according to SEQ ID NOs: 250 or 252, a homolog, a fragment or a variant thereof;
e.) optionally, a poly(A) sequence preferably comprising 64 adenosines; and
f.) optionally, a poly(C) sequence, preferably comprising 30 cytosines.

According to a particularly preferred embodiment the RNA sequence according to the invention comprises, preferably in 5'- to 3'-direction:
a.) a 5'-cap structure, preferably m7GpppN;
b.) a 5'-UTR element which comprises or consists of a nucleic acid sequence which is derived from the 5'-UTR of a TOP gene (SEQ ID NOs: 235-238), a homolog, a fragment or a variant thereof;
c1.) optionally, at least one coding sequence encoding at least one heterologous secretory signal sequence, preferably selected from SEQ ID NOs 317-572;
c2.) at least one coding sequence encoding at least one antigenic peptide or protein derived from a Nipah virus protein or peptide or a fragment or variant thereof, preferably comprising or consisting of any one of the nucleic acid sequences according to SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1516-1539 or a fragment or variant thereof;

d.) a 3'-UTR element comprising or consisting of a nucleic acid sequence which is derived from a gene providing a stable RNA, preferably comprising or consisting of the corresponding RNA sequence of a nucleic acid sequence according to SEQ ID NOs: 250 or 252, a homolog, a fragment or a variant thereof;

e.) optionally, a poly(A) sequence preferably comprising 64 adenosines; and f.) optionally, a poly(C) sequence, preferably comprising 30 cytosines.

Histone Stem-Loop:

In a particularly preferred embodiment, the nucleic acid sequence, particularity the RNA sequence according to the invention comprises a histone stem-loop sequence/structure. Such histone stem-loop sequences are preferably selected from histone stem-loop sequences as disclosed in WO 2012/019780, the disclosure of which is incorporated herewith by reference.

A histone stem-loop sequence suitable to be used within the present invention is preferably derived from formulae (I) or (II) of the patent application WO2012/019780, herewith incorporated by reference. According to a further preferred embodiment the RNA as defined herein may comprise at least one histone stem-loop sequence derived from at least one of the specific formulae (Ia) or (IIa) of the patent application WO2012/019780.

A particular preferred histone stem-loop sequence is the sequence according to SEQ ID NO: 253 or more preferably the corresponding RNA sequence according to SEQ ID NO: 254.

Accordingly, in preferred embodiments, the artificial nucleic acid of the invention comprises at least one histone stem-loop as defined herein. Preferably, the at least one histone stem loop comprises a nucleic acid sequence according to SEQ ID NOs: 253 or 254, or a fragment or variant thereof.

In particularly preferred embodiments, the artificial nucleic acid, preferably the artificial mRNA of the invention comprises a 3'-terminal sequence element comprising a poyl(A)sequence as defined herein and a histons-stem-loop sequence as defined herein, wherein the 3'-terminal sequence element may be selected from SEQ ID NOs: 1509, 1510, 1511 or 1512.

mRNA Structures:

Any of the above modifications may be applied to the nucleic acid sequence, in particular, to the DNA and/or RNA sequence of the present invention, and further to any DNA or RNA as used in the context of the present invention and may be, if suitable or necessary, be combined with each other in any combination, provided, these combinations of modifications do not interfere with each other in the respective nucleic acid sequence. A person skilled in the art will be able to take his choice accordingly.

The artificial nucleic acid sequence according to the invention, particularly the RNA sequence according to the present invention which comprises at least one coding sequence as defined herein, may preferably comprise a 5'-UTR and/or a 3'-UTR preferably containing at least one histone stem-loop. The 3'-UTR of the RNA sequence according to the invention preferably comprises also a poly(A) and/or a poly(C) sequence as defined herein. The single elements of the 3'-UTR may occur therein in any order from 5' to 3' along the sequence of the RNA sequence of the present invention. In addition, further elements as described herein, may also be contained, such as a stabilizing sequence as defined herein (e.g. derived from the UTR of a globin gene), IRES sequences, etc. Each of the elements may also be repeated in the RNA sequence according to the invention at least once (particularly in di- or multicistronic constructs), preferably twice or more. As an example, the single elements may be present in the nucleic acid sequence, particularly in the RNA sequence according to the invention in the following order:

5'-coding sequence-histone stem-loop-poly(A)/(C) sequence-3'; or

5'-coding sequence-poly(A)/(C) sequence-histone stem-loop-3'; or

5'-coding sequence-histone stem-loop-polyadenylation signal-3'; or

5'-coding sequence-polyadenylation signal-histone stem-loop-3'; or

5'-coding sequence-histone stem-loop-histone stem-loop-poly(A)/(C) sequence-3'; or 5'-coding sequence-histone stem-loop-histone stem-loop-polyadenylation signal-3'; or 5'-coding sequence-stabilizing sequence-poly(A)/(C) sequence-histone stem-loop-3'; or 5'-coding sequence-stabilizing sequence-poly(A)/(C) sequence-poly(A)/(C) sequence-histone stem-loop-3"; etc.

According to a further embodiment, the nucleic acid sequence of the present invention, particularly the RNA sequence of the present invention, preferably comprises at least one of the following structural elements: a 5'- and/or 3'-untranslated region element (UTR element), particularly a 5'-UTR element, which preferably comprises or consists of a nucleic acid sequence which is derived from the 5'-UTR of a TOP gene or from a fragment, homolog or a variant thereof, or a 5'- and/or 3'-UTR element which may preferably be derivable from a gene that provides a stable RNA or from a homolog, fragment or variant thereof; a histone-stem-loop structure, preferably a histone-stem-loop in its 3' untranslated region; a 5'-cap structure; a poly-A tail; or a poly(C) sequence.

In preferred embodiments the nucleic acid sequence, in particular, the RNA sequence comprises, preferably in 5'- to 3'-direction, the following elements a)-h):
a) 5'-cap structure, preferably as defined herein;
b) optionally, 5'-UTR element, preferably as defined herein;
c) at least one coding sequence, preferably as defined herein;
d) a 3'-UTR element, preferably as defined herein;
e) optionally, poly(A) sequence, preferably as defined herein;
f) optionally, poly(C) sequence, preferably as defined herein;
g) optionally, a histone stem-loop, preferably as defined herein; and
h) optionally, a 3'-terminal sequence element as defined herein.

In a preferred embodiment the nucleic acid sequence, in particular, the RNA sequence comprises, preferably in 5'- to 3'-direction:
a.) a 5'-cap structure, preferably m7GpppN;
b1.) optionally, at least one coding sequence encoding at least one heterologous secretory signal sequence;
b2.) at least one coding sequence encoding at least one antigenic peptide or protein derived from a Henipavirus protein or peptide as defined herein or a fragment or variant thereof;
c.) a 3'-UTR element comprising or consisting of a nucleic acid sequence which is derived from an alpha globin gene, preferably comprising the corresponding RNA sequence of the nucleic acid sequence according to SEQ ID NO: 246, a homolog, a fragment or a variant thereof;
d.) optionally, a poly(A) sequence, preferably comprising 64 adenosines;
e.) optionally, a poly(C) sequence, preferably comprising 30 cytosines;
f.) optionally, a histone stem-loop, preferably comprising the RNA sequence according to SEQ ID NO: 254;
g.) optionally, a poly(A) sequence and a histone stem-loop comprising the RNA sequence according to SEQ ID NOs: 1509, 1510, 1511 or 1512

In a particularly preferred embodiment the nucleic acid sequence, in particular, the RNA sequence comprises, preferably in 5'- to 3'-direction:
a.) a 5'-cap structure, preferably m7GpppN;
b1.) optionally, at least one coding sequence encoding at least one heterologous secretory signal sequence according to SEQ ID NOs: 317-572;
b2.) at least one coding sequence encoding at least one antigenic peptide or protein derived from a Hendra virus protein or peptide or a fragment or variant thereof, preferably comprising or consisting of any one of the nucleic acid according to 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274 or a fragment or variant thereof;
c.) a 3'-UTR element comprising or consisting of a nucleic acid sequence which is derived from an alpha globin gene, preferably comprising the corresponding RNA sequence of the nucleic acid sequence according to SEQ ID NO: 246, a homolog, a fragment or a variant thereof;
d.) optionally, a poly(A) sequence, preferably comprising 64 adenosines;
e.) optionally, a poly(C) sequence, preferably comprising 30 cytosines;
f.) optionally, a histone stem-loop, preferably comprising the RNA sequence according to SEQ ID NO: 254;
g.) optionally, a poly(A) sequence and a histone stem-loop comprising the RNA sequence according to SEQ ID NOs: 1509, 1510, 1511 or 1512

In a further particularly preferred embodiment the nucleic acid sequence, in particular, the RNA sequence comprises, preferably in 5'- to 3'-direction:
a.) a 5'-cap structure, preferably m7GpppN;
b1.) optionally, at least one coding sequence encoding at least one heterologous secretory signal sequence according to SEQ ID NOs: 317-572;
b2.) at least one coding sequence encoding at least one antigenic peptide or protein derived from a Nipah virus protein or peptide or a fragment or variant thereof, preferably comprising or consisting of any one of the nucleic acid according to SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1516-1539 or a fragment or variant thereof;
c.) a 3'-UTR element comprising or consisting of a nucleic acid sequence which is derived from an alpha globin gene, preferably comprising the corresponding RNA sequence of the nucleic acid sequence according to SEQ ID NO: 246, a homolog, a fragment or a variant thereof;
d.) optionally, a poly(A) sequence, preferably comprising 64 adenosines;
e.) optionally, a poly(C) sequence, preferably comprising 30 cytosines;
f.) optionally, a histone stem-loop, preferably comprising the RNA sequence according to SEQ ID NO: 254;
g.) optionally, a poly(A) sequence and a histone stem-loop comprising the RNA sequence according to SEQ ID NOs: 1509, 1510, 1511 or 1512

According to another particularly preferred embodiment the nucleic acid sequence, in particular, the RNA sequence according to the invention comprises, preferably in 5'- to 3'-direction:

a.) a 5'-cap structure, preferably m7GpppN;
b.) a 5'-UTR element which comprises or consists of a nucleic acid sequence which is derived from the 5'-UTR of a TOP gene (SEQ ID NOs: 235-238), a homolog, a fragment or a variant thereof;
c1.) optionally, at least one coding sequence encoding at least one heterologuous secretory signal sequence according to SEQ ID NOs: 317-572;
c2.) at least one coding sequence encoding at least one antigenic peptide or protein derived from a Hendra virus protein or peptide or a fragment or variant thereof, preferably comprising or consisting of any one of the nucleic acid sequences according to SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274 or a fragment or variant thereof;
d.) a 3'-UTR element comprising or consisting of a nucleic acid sequence which is derived from a gene providing a stable RNA, preferably comprising or consisting of the corresponding RNA sequence of a nucleic acid sequence according to SEQ ID NOs: 250 or 252, a homolog, a fragment or a variant thereof;
e.) optionally, a poly(A) sequence preferably comprising 64 adenosines;
f.) optionally, a poly(C) sequence, preferably comprising 30 cytosines;
g.) optionally, a histone stem-loop, preferably comprising the RNA sequence according to SEQ ID NO: 254;
h.) optionally, a poly(A) sequence and a histone stem-loop comprising the RNA sequence according to SEQ ID NOs: 1509, 1510, 1511 or 1512.

According to another particularly preferred embodiment the nucleic acid sequence, in particular, the RNA sequence according to the invention comprises, preferably in 5'- to 3'-direction:

a.) a 5'-cap structure, preferably m7GpppN;
b.) a 5'-UTR element which comprises or consists of a nucleic acid sequence which is derived from the 5'-UTR of a TOP gene (SEQ ID NOs: 235-238), a homolog, a fragment or a variant thereof;
c1.) optionally, at least one coding sequence encoding at least one heterologuous secretory signal sequence according to SEQ ID NOs: 317-572;
c2.) at least one coding sequence encoding at least one antigenic peptide or protein derived from a Nipah virus protein or peptide or a fragment or variant thereof, preferably comprising or consisting of any one of the nucleic acid sequences according to SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1516-1539 or a fragment or variant thereof;
d.) a 3'-UTR element comprising or consisting of a nucleic acid sequence which is derived from a gene providing a stable RNA, preferably comprising or consisting of the corresponding RNA sequence of a nucleic acid sequence according to SEQ ID NOs: 250 or 252, a homolog, a fragment or a variant thereof;
e.) optionally, a poly(A) sequence preferably comprising 64 adenosines;
f.) optionally, a poly(C) sequence, preferably comprising 30 cytosines;
g.) optionally, a histone stem-loop, preferably comprising the RNA sequence according to SEQ ID NO: 254;
h.) optionally, a poly(A) sequence and a histone stem-loop comprising the RNA sequence according to SEQ ID NOs: 1509, 1510, 1511 or 1512.

Preferred Hendra and Nipah Constructs of the Invention:

In the following, preferred and particularly suitable Hendra virus and Nipah virus mRNA sequences of the invention are provided.

Preferred Hendra polypeptide, nucleic acid and mRNA sequences are provided in Table 5. Therein, each row (row 1-36) represents a specific suitable Hendra virus construct of the invention. The protein design/name is indicated for each row (column "Name"). Accession numbers are provided in the <223> identifier of the respective SEQ ID NOs in the sequence listing. Column "SEQ ID NO: Protein" provides the respective SEQ ID NOs of the protein constructs as provided in the sequence listing. mRNA constructs comprising coding sequences encoding said proteins are provided in column "SEQ ID NO: mRNA design 1" column "SEQ ID NO: mRNA design 2" and column "SEQ ID NO: mRNA design 3". Additional information regarding each of the sequences provided in Table 5 may also be derived from the sequence listing, in particular from the details provided therein under identifier <223>.

TABLE 5

Preferred Hendra virus polypeptide, nucleic acid and mRNA sequences

| Row | Name | SEQ ID NO: Protein | SEQ ID NO: mRNA design 1 | SEQ ID NO: mRNA design 2 | SEQ ID NO: mRNA design 3 |
|---|---|---|---|---|---|
| 1 | F | 8 | 1282 | 1360 | 1438 |
| 2 | F | 9 | 1283 | 1361 | 1439 |
| 3 | F | 10 | 1284 | 1362 | 1440 |
| 4 | F | 11 | 1285 | 1363 | 1441 |
| 5 | HsIgE(1-18)_F(27-546) | 814 | 1308 | 1386 | 1464 |
| 6 | HsIgE(1-18)_F(27-546) | 815 | 1309 | 1387 | 1465 |
| 7 | HsIgE(1-18)_F(26-546) | 816 | 1310 | 1388 | 1466 |

TABLE 5-continued

Preferred Hendra virus polypeptide, nucleic acid and mRNA sequences

| Row | Name | SEQ ID NO: Protein | SEQ ID NO: mRNA design 1 | SEQ ID NO: mRNA design 2 | SEQ ID NO: mRNA design 3 |
|---|---|---|---|---|---|
| 8 | HsIgE(1-18)_F(27-546) | 817 | 1311 | 1389 | 1467 |
| 9 | H1N1-HA(1-17)_F(27-546) | 1048 | 1334 | 1412 | 1490 |
| 10 | H1N1-HA(1-17)_F(27-546) | 1049 | 1335 | 1413 | 1491 |
| 11 | H1N1-HA(1-17)_F(26-546) | 1050 | 1336 | 1414 | 1492 |
| 12 | H1N1-HA(1-17)_F(27-546) | 1051 | 1337 | 1415 | 1493 |
| 13 | G | 19 | 1293 | 1371 | 1449 |
| 14 | G | 20 | 1294 | 1372 | 1450 |
| 15 | G | 21 | 1295 | 1373 | 1451 |
| 16 | G | 22 | 1296 | 1374 | 1452 |
| 17 | G | 23 | 1297 | 1375 | 1453 |
| 18 | G | 24 | 1298 | 1376 | 1454 |
| 19 | G | 25 | 1299 | 1377 | 1455 |
| 20 | G | 26 | 1300 | 1378 | 1456 |
| 21 | HsIgE(1-18)_G(70-604) | 825 | 1319 | 1397 | 1475 |
| 22 | HsIgE(1-18)_G(70-604) | 826 | 1320 | 1398 | 1476 |
| 23 | HsIgE(1-18)_G(70-604) | 827 | 1321 | 1399 | 1477 |
| 24 | HsIgE(1-18)_G(70-604) | 828 | 1322 | 1400 | 1478 |
| 25 | HsIgE(1-18)_G(70-604) | 829 | 1323 | 1401 | 1479 |
| 26 | HsIgE(1-18)_G(70-604) | 830 | 1324 | 1402 | 1480 |
| 27 | HsIgE(1-18)_G(70-604) | 831 | 1325 | 1403 | 1481 |
| 28 | HsIgE(1-18)_G(70-604) | 832 | 1326 | 1404 | 1482 |
| 29 | H1N1-HA(1-17)_G(70-604) | 1059 | 1345 | 1423 | 1501 |
| 30 | H1N1-HA(1-17)_G(70-604) | 1060 | 1346 | 1424 | 1502 |
| 31 | H1N1-HA(1-17)_G(70-604) | 1061 | 1347 | 1425 | 1503 |
| 32 | H1N1-HA(1-17)_G(70-604) | 1062 | 1348 | 1426 | 1504 |
| 33 | H1N1-HA(1-17)_G(70-604) | 1063 | 1349 | 1427 | 1505 |
| 34 | H1N1-HA(1-17)_G(70-604) | 1064 | 1350 | 1428 | 1506 |
| 35 | H1N1-HA(1-17)_G(70-604) | 1065 | 1351 | 1429 | 1507 |
| 36 | H1N1-HA(1-17)_G(70-604) | 1066 | 1352 | 1430 | 1508 |

Preferred Nipah polypeptide, nucleic acid and mRNA sequences are provided in Table 6. Therein, each row (row 1-42) represents a specific suitable Nipah virus construct of the invention. The protein design/name is indicated for each row (column "Name"). Accession numbers are provided in the <223> identifier of the respective SEQ ID NOs in the sequence listing. Column "SEQ ID NO: Protein" provides the respective SEQ ID NOs of the protein constructs as provided in the sequence listing. mRNA constructs comprising coding sequences encoding said proteins are provided in column "SEQ ID NO: mRNA design 1" column "SEQ ID NO: mRNA design 2" and column "SEQ ID NO: mRNA design 3". Additional information regarding each of the sequences provided in Table 5 may also be derived from the sequence listing, in particular from the details provided therein under identifier <223>.

TABLE 6

Preferred Nipah virus polypeptide, nucleic acid and mRNA sequences

| Row | Name | SEQ ID NO: Protein | SEQ ID NO: mRNA design 1 | SEQ ID NO: mRNA design 2 | SEQ ID NO: mRNA design 3 |
|---|---|---|---|---|---|
| 1 | F | 1 | 1275 | 1353 | 1431 |
| 2 | F | 2 | 1276 | 1354 | 1432 |
| 3 | F | 3 | 1277 | 1355 | 1433 |
| 4 | F | 4 | 1278 | 1356 | 1434 |
| 5 | F | 5 | 1279 | 1357 | 1435 |
| 6 | F | 6 | 1280 | 1358 | 1436 |
| 7 | F | 7 | 1281 | 1359 | 1437 |
| 8 | HsIgE(1-18)_F(27-546) | 807 | 1301 | 1379 | 1457 |
| 9 | HsIgE(1-18)_F(27-546) | 808 | 1302 | 1380 | 1458 |
| 10 | HsIgE(1-18)_F(27-546) | 809 | 1303 | 1381 | 1459 |
| 11 | HsIgE(1-18)_F(27-546) | 810 | 1304 | 1382 | 1460 |
| 12 | HsIgE(1-18)_F(27-546) | 811 | 1305 | 1383 | 1461 |
| 13 | HsIgE(1-18)_F(27-546) | 812 | 1306 | 1384 | 1462 |
| 14 | HsIgE(1-18)_F(27-546) | 813 | 1307 | 1385 | 1463 |
| 15 | H1N1-HA(1-17)_F(27-546) | 1041 | 1327 | 1405 | 1483 |
| 16 | H1N1-HA(1-17)_F(27-546) | 1042 | 1328 | 1406 | 1484 |
| 17 | H1N1-HA(1-17)_F(27-546) | 1043 | 1329 | 1407 | 1485 |
| 18 | H1N1-HA(1-17)_F(27-546) | 1044 | 1330 | 1408 | 1486 |
| 19 | H1N1-HA(1-17)_F(27-546) | 1045 | 1331 | 1409 | 1487 |
| 20 | H1N1-HA(1-17)_F(27-546) | 1046 | 1332 | 1410 | 1488 |
| 21 | H1N1-HA(1-17)_F(27-546) | 1047 | 1333 | 1411 | 1489 |
| 22 | G | 12 | 1286 | 1364 | 1442 |
| 23 | G | 13 | 1287 | 1365 | 1443 |
| 24 | G | 14 | 1288 | 1366 | 1444 |
| 25 | G | 15 | 1289 | 1367 | 1445 |

TABLE 6-continued

Preferred Nipah virus polypeptide, nucleic acid and mRNA sequences

| Row | Name | SEQ ID NO: Protein | SEQ ID NO: mRNA design 1 | SEQ ID NO: mRNA design 2 | SEQ ID NO: mRNA design 3 |
|---|---|---|---|---|---|
| 26 | G | 16 | 1290 | 1368 | 1446 |
| 27 | G | 17 | 1291 | 1369 | 1447 |
| 28 | G | 18 | 1292 | 1370 | 1448 |
| 29 | HsIgE(1-18)_G(70-602) | 818 | 1312 | 1390 | 1468 |
| 30 | HsIgE(1-18)_G(70-602) | 819 | 1313 | 1391 | 1469 |
| 31 | HsIgE(1-18)_G(70-602) | 820 | 1314 | 1392 | 1470 |
| 32 | HsIgE(1-18)_G(70-602) | 821 | 1315 | 1393 | 1471 |
| 33 | HsIgE(1-18)_G(70-602) | 822 | 1316 | 1394 | 1472 |
| 34 | HsIgE(1-18)_G(70-602) | 823 | 1317 | 1395 | 1473 |
| 35 | HsIgE(1-18)_G(70-602) | 824 | 1318 | 1396 | 1474 |
| 36 | H1N1-HA(1-17)_G(70-602) | 1052 | 1338 | 1416 | 1494 |
| 37 | H1N1-HA(1-17)_G(70-602) | 1053 | 1339 | 1417 | 1495 |
| 38 | H1N1-HA(1-17)_G(70-602) | 1054 | 1340 | 1418 | 1496 |
| 39 | H1N1-HA(1-17)_G(70-602) | 1055 | 1341 | 1419 | 1497 |
| 40 | H1N1-HA(1-17)_G(70-602) | 1056 | 1342 | 1420 | 1498 |
| 41 | H1N1-HA(1-17)_G(70-602) | 1057 | 1343 | 1421 | 1499 |
| 42 | H1N1-HA(1-17)_G(70-602) | 1058 | 1344 | 1422 | 1500 |
| 43 | HsSPARC(1-17)_F(27-546) | 1513 | 1540 | 1543 | 1546 |
| 44 | HsCTRB2(1-18)_F(27-546) | 1514 | 1541 | 1544 | 1547 |
| 45 | Nipah henipavirus_AAK50553_F(1-26)F(27-546) | 1515 | 1542 | 1545 | 1548 |

Accordingly, it is particularly preferred that the nucleic acid sequence according to the invention comprises or consists of a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the mRNA sequences according to SEQ ID NOs: 1275-1508, 1540-1548 or a fragment or variant thereof.

Accordingly, it is particularly preferred that the nucleic acid sequence according to the invention comprises or consists of a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the mRNA sequences according to SEQ ID NOs: 1282-1285, 1293-1300, 1308-1311, 1319-1326, 1334-1337, 1345-1352, 1360-1363, 1371-1378, 1386-1389, 1397-1404, 1412-1415, 1423-1430, 1438-1441, 1464-1467, 1490-1493, 1449-1456, 1475-1482, 1501-1508 or a fragment or variant thereof.

Accordingly, it is particularly preferred that the nucleic acid sequence according to the invention comprises or consists of a nucleic acid sequence selected from sequences being identical or at least 50%, 60%, 70%, 80%, 85%, 86%, 87%, 88%, 89%, 90%, 91%, 92%, 93%, 94%, 95%, 96%, 97%, 98%, or 99% identical to the mRNA sequences according to SEQ ID NOs: 1275-1281, 1286-1292, 1301-1307, 1312-1318, 1327-1333, 1338-1344, 1353-1359, 1364-1370, 1379-1385, 1390-1396, 1405-1411, 1416-1422, 1431-1437, 1457-1463, 1483-1489, 1442-1448, 1468-1474, 1494-1500, 1540-1548 or a fragment or variant thereof.

Composition:

In a further aspect, the present invention concerns a composition comprising at least one artificial nucleic acid comprising at least one coding sequence as defined herein and a pharmaceutically acceptable carrier. The composition according to the invention is preferably provided as a pharmaceutical composition or as a vaccine.

According to a preferred embodiment, the (pharmaceutical) composition or the vaccine according to the invention comprises at least one nucleic acid of the present invention, wherein the at least one coding sequence of the at least one nucleic acid sequence encodes at least one Henipavirus peptide or protein selected from Henipavirus RNA-directed RNA polymerase (L), Henipavirus fusion protein (F), Henipavirus non-structural protein (V), Henipavirus glycoprotein (G), Henipavirus nucleoprotein (N), Henipavirus matrix protein (M), Henipavirus phosphoprotein (P), Henipavirus protein C, and Henipavirus protein W, as well as to fragments or variants of all these proteins.

The (pharmaceutical) composition or vaccine according to the invention may thus comprise at least one nucleic acid comprising at least one nucleic acid sequence comprising at least one coding region, encoding at least one Henipavirus antigenic peptide or protein, particularly, at least one Henipavirus protein selected from Henipavirus RNA-directed RNA polymerase (L), Henipavirus fusion protein (F), Henipavirus non-structural protein (V), Henipavirus glycoprotein (G), Henipavirus nucleoprotein (N), Henipavirus matrix protein (M), Henipavirus phosphoprotein (P), Henipavirus protein C, and Henipavirus protein W, a fragment or variant thereof, wherein the at least one coding region of the at least one nucleic acid sequence encodes one specific Henipavirus antigenic peptide or protein as defined herein or a fragment or a variant thereof.

According to a further preferred embodiment, the (pharmaceutical) composition or the vaccine according to the invention comprises at least one nucleic acid of the present invention, wherein the at least one coding sequence of the at least one nucleic acid sequence encodes at least one Hendra virus peptide or protein selected from Hendra virus RNA-directed RNA polymerase (L), Hendra virus fusion protein (F), Hendra virus non-structural protein (V), Hendra virus glycoprotein (G), Hendra virus nucleoprotein (N), Hendra virus matrix protein (M), Hendra virus phosphoprotein (P), Hendra virus protein C, and Hendra virus protein W, as well as to fragments or variants of all these proteins.

In a particularly preferred embodiment, the (pharmaceutical) composition or the vaccine according to the invention comprises at least one nucleic acid of the present invention, wherein the at least one coding sequence of the at least one nucleic acid sequence encodes at least one Hendra virus peptide or protein selected from Hendra virus fusion protein (F) and Hendra virus glycoprotein (G) (and optionally a secretory signal sequence) as well as to fragments or variants of all these proteins, preferably proteins or peptides according to SEQ ID NOs: 8-11, 19-26, 580-583, 591-598, 814-817, 825-832, 1048-1051, 1059-1066 or a homolog, fragment or variant of any of these sequences (see Table 1 and Table 1B, column "A").

Preferably, the (pharmaceutical) composition or the vaccine according to the invention comprises at least one nucleic acid of the present invention, wherein the at least one coding sequence of the at least one nucleic acid sequence encodes at least one Hendra virus peptide or protein selected from Hendra virus fusion protein (F) and Hendra virus glycoprotein (G) (and, optionally, a secretory signal sequence) as well as to fragments or variants of all these proteins, wherein the Hendra virus peptide or protein preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences according to SEQ ID NOs: 8-11, 19-26, 580-583, 591-598, 814-817, 825-832, 1048-1051, 1059-1066, or a homolog, fragment or variant of any of these sequences (see Table 1 and Table 1B, column "A") fragment or variant of any one of these sequences.

More preferably, the (pharmaceutical) composition or the vaccine according to the invention comprises at least one nucleic acid comprising at least one nucleic acid sequence of the present invention, wherein the at least one coding sequence of the at least one nucleic acid sequence comprises or consists of a nucleic acid sequence encoding at least one Hendra virus peptide or protein (and, optionally, a secretory signal sequence) preferably comprises or consists of an amino acid sequence having a sequence identity of at least 80% with any one of the amino acid sequences according to SEQ ID NOs: 8-11, 19-26, 580-583, 591-598, 814-817, 825-832, 1048-1051, 1059-1066, or a homolog, fragment or variant of any of these sequences (see Table 1 and Table 1B, column "A") fragment or variant of any one of these sequences.

In preferred embodiments, the (pharmaceutical) composition or the vaccine according to the invention comprises at least one nucleic acid comprising at least one nucleic acid sequence of the present invention, wherein the at least one coding sequence (encoding at least one Hendra virus antigenic peptide or protein, and, optionally, a secretory signal sequence) of the at least one nucleic acid sequence comprises or consists of any one of the nucleic acid sequences according to SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274 (as defined in Table 1 and Table 1B) or a fragment or variant of any one of these sequences.

According to another embodiment, the (pharmaceutical) composition or the vaccine according to the invention comprises at least one nucleic acid comprising at least one nucleic acid sequence of the present invention, wherein the at least one coding sequence (encoding at least one Hendra virus antigenic peptide or protein, and, optionally, a secretory signal sequence) of the at least one nucleic acid sequence comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NOs: 34-37, 45-52, 60-63, 71-78, 86-89, 97-104, 112-115, 123-130, 138-141, 149-156, 164-167, 175-182, 190-193, 201-208, 216-219, 227-234, 606-609, 632-635, 658-661, 684-687, 710-713, 736-739, 762-765, 788-791, 617-624, 643-650, 669-676, 695-702, 721-728, 747-754, 773-780, 799-806, 840-843, 866-869, 892-895, 918-921, 944-947, 970¬-973, 996-999, 1022-1025, 851-858, 877-884, 903-910, 929-936, 955-962, 981-988, 1007-1014, 1033-1040, 1074-1077, 1100-1103, 1126-1129, 1152-1155, 1178-1181, 1204-1207, 1230-1233, 1256-1259, 1085-1092, 1111-1118, 1137-1144, 1163-1170, 1189-1196, 1215-1222, 1241-1248, 1267-1274 (as defined in Table 1 and Table 1B) or a fragment or variant of any one of these sequences.

According to another preferred embodiment, the (pharmaceutical) composition or the vaccine according to the invention comprises at least one nucleic acid comprising at least one nucleic acid sequence of the present invention, wherein the at least one coding sequence (encoding at least one Hendra virus antigenic peptide or protein, and, optionally, a secretory signal sequence) of the at least one nucleic acid sequence comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the mRNA sequences according to SEQ ID NOs: 1282-1285, 1293-1300, 1308-1311, 1319-1326, 1334-1337, 1345-1352, 1360-1363, 1371-1378, 1386-1389, 1397-1404, 1412-1415, 1423-1430, 1438-1441, 1464-1467, 1490-1493, 1449-1456, 1475-1482, 1501-1508 (as defined in Table 5) or a fragment or variant of any one of these sequences.

In the context of the present invention, the (pharmaceutical) composition or vaccine may encode one or more of the Hendra virus antigenic proteins or peptides as defined herein or a fragment or variant thereof.

The (pharmaceutical) composition or vaccine according to the invention may thus comprise at least one nucleic acid comprising at least one nucleic acid sequence comprising at least one coding region, encoding at least one Hendra virus antigenic peptide or protein, particularly, at least one Hendra virus protein selected from Hendra virus RNA-directed RNA polymerase (L), Hendra virus fusion protein (F), Hendra virus non-structural protein (V), Hendra virus glycoprotein (G), Hendra virus nucleoprotein (N), Hendra virus matrix protein (M), Hendra virus phosphoprotein (P), Hendra virus protein C, and Hendra virus protein W, a fragment or variant thereof, wherein the at least one coding region of the at least one nucleic acid sequence encodes one specific Hendra virus antigenic peptide or protein as defined herein or a fragment or a variant thereof.

According to a further preferred embodiment, the (pharmaceutical) composition or the vaccine according to the invention comprises at least one nucleic acid of the present invention, wherein the at least one coding sequence of the at least one nucleic acid sequence encodes at least one Nipah virus peptide or protein selected from Nipah virus RNA-directed RNA polymerase (L), Nipah virus fusion protein (F), Nipah virus non-structural protein (V), Nipah virus glycoprotein (G), Nipah virus nucleoprotein (N), Nipah virus matrix protein (M), Nipah virus phosphoprotein (P), Nipah virus protein C, and Nipah virus protein W, as well as to fragments or variants of all these proteins.

In a particularly preferred embodiment, the (pharmaceutical) composition or the vaccine according to the invention comprises at least one nucleic acid of the present invention, wherein the at least one coding sequence of the at least one nucleic acid sequence encodes at least one Nipah virus peptide or protein selected from Nipah virus fusion protein (F) and Nipah virus glycoprotein (G) (and, optionally, a secretory signal sequence) as well as to fragments or variants of all these proteins, preferably proteins or peptides according to SEQ ID NOs: 1-7, 12-18, 573-579, 584-590, 807-813, 818-824, 1041-1047, 1052-1058, 1513-1515 or a homolog, fragment or variant of any of these sequences (see Table 2 and Table 2B, column "A").

Preferably, the (pharmaceutical) composition or the vaccine according to the invention comprises at least one nucleic acid of the present invention, wherein the at least one coding sequence of the at least one nucleic acid sequence encodes at least one Nipah virus peptide or protein selected from Nipah virus fusion protein (F) and Nipah virus glycoprotein (G) (and, optionally, a secretory signal sequence) as well as to fragments or variants of all these proteins, wherein the Nipah virus peptide or protein preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the amino acid sequences according to SEQ ID NOs: 1-7, 12-18, 573-579, 584-590, 807-813, 818-824, 1041-1047, 1052-1058, or a homolog, fragment or variant of any of these sequences (see Table 2 and Table 2B, column "A") fragment or variant of any one of these sequences.

More preferably, the (pharmaceutical) composition or the vaccine according to the invention comprises at least one nucleic acid comprising at least one nucleic acid sequence of the present invention, wherein the at least one coding sequence of the at least one nucleic acid sequence comprises or consists of a nucleic acid sequence encoding at least one Nipah virus peptide or protein (and, optionally, a secretory signal sequence) preferably comprises or consists of an amino acid sequence having a sequence identity of at least 80% with any one of the amino acid sequences according to SEQ ID NOs: 1-7, 12-18, 573-579, 584-590, 807-813, 818-824, 1041-1047, 1052-1058, 1513-1515 or a homolog, fragment or variant of any of these sequences (see Table 2 and Table 2B, column "A") fragment or variant of any one of these sequences.

In preferred embodiments, the (pharmaceutical) composition or the vaccine according to the invention comprises at least one nucleic acid comprising at least one nucleic acid sequence of the present invention, wherein the at least one coding sequence (encoding at least one Nipah virus antigenic peptide or protein, and, optionally, a secretory signal sequence) of the at least one nucleic acid sequence comprises or consists of any one of the nucleic acid sequences according to SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1516-1539 (as defined in Table 2 and Table 2B) or a fragment or variant of any one of these sequences.

According to another embodiment, the (pharmaceutical) composition or the vaccine according to the invention comprises at least one nucleic acid comprising at least one nucleic acid sequence of the present invention, wherein the at least one coding sequence (encoding at least one Nipah virus antigenic peptide or protein, and, optionally, a secretory signal sequence) of the at least one nucleic acid sequence comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences according to SEQ ID NOs: 27-33, 38-44, 53-59, 64-70, 79-85, 90-96, 105-111, 116-122, 131-137, 142-148, 157-163, 168-174, 183-189, 194-200, 209-215, 220-226, 599-605, 625-631, 651-657, 677-683, 703-709, 729-735, 755-761, 781-787, 610-616, 636-642, 662-668, 688-694, 714-720, 740-746, 766-772, 792-798, 833-839, 859-865, 885-891, 911-917, 937-943, 963-969, 989-995, 1015-1021, 844-850, 870-876, 896-902, 922-928, 948-954, 974-980, 1000-1006, 1026-1032, 1067-1073, 1093-1099, 1119-1125, 1145-1151, 1171-1177, 1197-1203, 1223-1229, 1249-1255, 1078-1084, 1104-1110, 1130-1136, 1156-1162, 1182-1188, 1208-1214, 1234-1240, 1260-1266, 1516-1539 (as defined in Table 2 and Table 2B) or a fragment or variant of any one of these sequences.

According to another preferred embodiment, the (pharmaceutical) composition or the vaccine according to the invention comprises at least one nucleic acid comprising at least one nucleic acid sequence of the present invention, wherein the at least one coding sequence (encoding at least one Nipah virus antigenic peptide or protein and, optionally, a secretory signal sequence) of the at least one nucleic acid sequence comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the mRNA sequences according to SEQ ID NOs: 1275-1281, 1286-1292, 1301-1307, 1312-1318, 1327-1333, 1338-1344, 1353-1359, 1364-1370, 1379-1385, 1390-1396, 1405-1411, 1416-1422, 1431-1437, 1457-

1463, 1483-1489, 1442-1448, 1468-1474, 1494-1500, 1540-1548 (as defined in Table 6) or a fragment or variant of any one of these sequences In the context of the present invention, the (pharmaceutical) composition or vaccine may encode one or more of the Nipah virus antigenic proteins or peptides as defined herein or a fragment or variant thereof.

The (pharmaceutical) composition or vaccine according to the invention may thus comprise at least one nucleic acid comprising at least one nucleic acid sequence comprising at least one coding region, encoding at least one Nipah virus antigenic peptide or protein, particularly, at least one Nipah virus protein selected from Nipah virus RNA-directed RNA polymerase (L), Nipah virus fusion protein (F), Nipah virus non-structural protein (V), Nipah virus glycoprotein (G), Nipah virus nucleoprotein (N), Nipah virus matrix protein (M), Nipah virus phosphoprotein (P), Nipah virus protein C, and Nipah virus protein W, a fragment or variant thereof, wherein the at least one coding region of the at least one nucleic acid sequence encodes one specific Nipah virus antigenic peptide or protein as defined herein or a fragment or a variant thereof.

Alternatively, the (pharmaceutical) composition or vaccine of the present invention may comprise at least one nucleic acid comprising at least one nucleic acid sequence according to the invention, wherein the at least one nucleic acid sequence encodes at least two, three, four, five, six, seven, eight, nine, ten, eleven or twelve distinct Henipavirus and/or Hendra virus and/or Nipah virus antigenic peptides or proteins as defined herein or a fragment or variant thereof.

In this context it is particularly preferred that the at least one nucleic acid comprised in the (pharmaceutical) composition or vaccine is a bi- or multicistronic nucleic acid, particularly a bi- or multicistronic nucleic acid as defined herein, which encodes the at least two, three, four, five, six, seven, eight, nine, ten, eleven or twelve distinct Henipavirus and/or Hendra virus and/or Nipah virus peptides or proteins derived from a protein of a Henipavirus and/or Hendra virus and/or Nipah virus. Mixtures between these embodiments are also envisaged, such as compositions comprising more than one nucleic acid sequences, wherein at least one nucleic acid sequence may be monocistronic, while at least one other nucleic acid sequence may be bi- or multicistronic.

The (pharmaceutical) composition or vaccine according to the present invention, preferably the at least one coding sequence of the nucleic acid sequence comprised therein, may thus comprise any combination of the nucleic acid sequences as defined herein.

Preferably, the (pharmaceutical) composition or vaccine comprises a plurality or more than one of the nucleic sequences according to the invention, wherein each nucleic acid sequence comprises at least one coding region encoding at least one antigenic peptide or protein derived from a protein of a Henipavirus and/or Hendra virus and/or Nipah virus or a fragment or variant thereof.

In a particularly preferred embodiment, the composition comprises at least 2, 3, 4, 5, 6, 7, 8, 9, 10 or even more different artificial nucleic acids each encoding at least one antigenic peptide or protein derived from genetically the same Henipavirus and/or Hendra virus and/or Nipah virus or a fragment or variant thereof.

In another preferred embodiment each nucleic acid sequence encodes at least one different Henipavirus and/or Hendra virus and/or Nipah virus antigenic peptide or protein derived from proteins of different Henipavirus and/or Hendra virus and/or Nipah virus or a fragment or variant thereof.

In a particularly preferred embodiment, the composition comprises at least 2, 3, 4, 5, 6, 7, 8, 9, 10 or even more different artificial nucleic acids each encoding at least one peptide or protein derived from a different Henipavirus and/or Hendra virus and/or Nipah virus or a fragment or variant thereof.

In an embodiment, the composition comprises at least one artificial nucleic acid encoding at least one antigenic peptide or protein derived from Hendra virus fusion protein (F) and/or at least one artificial nucleic acid encoding at least one antigenic peptide or protein derived from Hendra virus glycoprotein (G) and/or at least one artificial nucleic acid encoding at least one antigenic peptide or protein derived from Nipah virus fusion protein (F) and/or at least one artificial nucleic acid encoding at least one antigenic peptide or protein derived from Nipah virus glycoprotein (G) or a fragment or variant thereof.

In a specific embodiment, the composition comprises at least one artificial nucleic acid encoding at least one antigenic peptide or protein derived from Hendra virus fusion protein (F) and at least one artificial nucleic acid encoding at least one antigenic peptide or protein derived from Hendra virus glycoprotein (G) or a fragment or variant thereof.

In a specific embodiment, the composition comprises at least one artificial nucleic acid encoding at least one antigenic peptide or protein derived from Nipah virus fusion protein (F) and at least one artificial nucleic acid encoding at least one antigenic peptide or protein derived from Nipah virus glycoprotein (G) or a fragment or variant thereof.

In a specific embodiment, the composition comprises at least one artificial nucleic acid encoding at least one antigenic peptide or protein derived from Nipah virus fusion protein (F) and at least one artificial nucleic acid encoding at least one antigenic peptide or protein derived from Hendra virus glycoprotein (G) or a fragment or variant thereof.

In a specific embodiment, the composition comprises at least one artificial nucleic acid encoding at least one antigenic peptide or protein derived from Nipah virus fusion protein (F) and at least one artificial nucleic acid encoding at least one antigenic peptide or protein derived from Hendra virus fusion protein (F) or a fragment or variant thereof.

In a specific embodiment, the composition comprises at least one artificial nucleic acid encoding at least one antigenic peptide or protein derived from Nipah virus glycoprotein (G) and at least one artificial nucleic acid encoding at least one antigenic peptide or protein derived from Hendra virus glycoprotein (G) or a fragment or variant thereof.

Complexation and Formulation:

In a preferred embodiment of the composition according to the invention, the at least one nucleic acid comprising at least one nucleic acid sequence according to the invention is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

According to a preferred embodiment, the at least one nucleic acid of the composition according to the present invention may be complexed with lipids to form one or more liposomes, lipoplexes, or lipid nanoparticles. Therefore, in one embodiment, the inventive composition comprises liposomes, lipoplexes, and/or lipid nanoparticles comprising the at least one nucleic acid, preferably RNA, more preferably mRNA.

Lipid-based formulations have been increasingly recognized as one of the most promising delivery systems for nucleic acids, particularly of RNA, due to their biocompatibility and their ease of large-scale production. Cationic lipids have been widely studied as synthetic materials for delivery of RNA. After mixing together, nucleic acids are condensed by cationic lipids to form lipid/nucleic acid complexes known as lipoplexes. These lipid complexes are able to protect genetic material from the action of nucleases and deliver it into cells by interacting with the negatively charged cell membrane. Lipoplexes can be prepared by directly mixing positively charged lipids at physiological pH with negatively charged nucleic acids.

Conventional liposomes consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains.

Liposomes are colloidal lipid-based and surfactant-based delivery systems composed of a phospholipid bilayer surrounding an aqueous compartment. They may present as spherical vesicles and can range in size from 20 nm to a few microns. Cationic lipid-based liposomes are able to complex with negatively charged nucleic acids via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the genetic material is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids.

Cationic liposomes have been traditionally the most commonly used non-viral delivery systems for oligonucleotides, including plasmid DNA, antisense oligos, and siRNA/small hairpin RNA-shRNA). Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency. Furthermore, neutral lipid-based nanoliposomes for RNA delivery as e.g. neutral 1,2-dioleoyl-sn-glycero-3-phosphatidylcholine (DOPC)-based nanoliposomes were developed.

Therefore, in one embodiment the at least one nucleic acid, preferably the RNA of the composition according to the present invention is complexed with cationic lipids and/or neutral lipids and thereby forms liposomes, lipid nanoparticles, lipoplexes or neutral lipid-based nanoliposomes.

In the context of the present invention, the term "lipid nanoparticle", also referred to as "LNP", is not restricted to any particular morphology, and includes any morphology generated when a cationic lipid and optionally one or more further lipids are combined, e.g. in an aqueous environment and/or in the presence of an RNA. For example, a liposome, a lipid complex, a lipoplex, an emulsion, a micelle, a lipidic nanocapsule, a nanosuspension and the like are within the scope of a lipid nanoparticle (LNP).

LNPs typically comprise a cationic lipid and one or more excipient selected from neutral lipids, charged lipids, steroids and polymer conjugated lipids (e.g. PEGylated lipid). The nucleic acid may be encapsulated in the lipid portion of the LNP or an aqueous space enveloped by some or the entire lipid portion of the LNP. The RNA or a portion thereof may also be associated and complexed with the LNP. An LNP may comprise any lipid capable of forming a particle to which the nucleic acids are attached, or in which the one or more nucleic acids are encapsulated. Preferably, the LNP comprising nucleic acids comprises one or more cationic lipids, and one or more stabilizing lipids. Stabilizing lipids include neutral lipids and PEGylated lipids.

In one embodiment, the LNP consists essentially of (i) at least one cationic lipid; (ii) a neutral lipid; (iii) a sterol, e.g., cholesterol; and (iv) a PEG-lipid, e.g. PEG-DMG or PEG-cDMA, in a molar ratio of about 20-60% cationic lipid:5-25% neutral lipid:25-55% sterol; 0.5-15% PEG-lipid.

In that context, a preferred sterol is cholesterol. The sterol can be about 10 mol % to about 60 mol % or about 25 mol % to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the LNPs include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

The cationic lipid of an LNP may be cationisable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

The LNP may comprise any further cationic or cationisable lipid, i.e. any of a number of lipid species which carry a net positive charge at a selective pH, such as physiological pH.

Such lipids include, but are not limited to, N,N-dioleyl-N,N-dimethylammonium chloride (DODAC); N-(2,3-dioleyloxy)propyl)-N,N,N-trimethylammonium chloride (DOTMA); N,N-distearyl-N,N-dimethylammonium bromide (DDAB); N-(2,3dioleoyloxy)propyl)-N,N,N-trimethylammonium chloride (DOTAP); 3-(N—(N',N'dimethylaminoethane)-carbamoyl)cholesterol (DC-Chol), N-(1-(2,3-dioleoyloxy)propyl)N-2-(sperminecarboxamido)ethyl)-N, N-dimethylammonium trifluoracetate (DOSPA), dioctadecylamidoglycyl carboxyspermine (DOGS), 1,2-dioleoyl-3-dimethylammonium propane (DODAP), N,N-dimethyl-2,3-dioleoyloxy)propylamine (DODMA), and N-(1, 2dimyristyloxyprop-3-yl)-N,N-dimethyl-N-hydroxyethyl ammonium bromide (DMRIE). In some aspects, the lipid is selected from the group consisting of 98N12-5, C12-200, and ckk-E12.

In some embodiments, the lipid is selected from the group consisting of 98N12-5, C12-200, and ckk-E12.

In one embodiment, the nucleic acids may be formulated in an aminoalcohol lipidoid. Aminoalcohol lipidoids which may be used in the present invention may be prepared by the methods described in U.S. Pat. No. 8,450,298, herein incorporated by reference in its entirety. Suitable ionizable lipids can also be the compounds as disclosed in Tables 1, 2 and 3 and claims 1-24 of International Publication No. WO 2017/075531 A1, hereby incorporated by reference in its entirety. In another embodiment, ionizable lipids can also be the compounds as disclosed in International Publication No. WO 2015/074085 A1 (i.e. ATX-001 to ATX-032 or the compounds as mentioned in claims 1-26), U.S. Appl. Nos. 61/905,724 and Ser. No. 15/614,499 or U.S. Pat. Nos. 9,593,077 and 9,567,296 hereby incorporated by reference in their entirety.

Additionally, a number of commercial preparations of cationic lipids are available which can be used in the present invention. These include, for example, LIPOFECTIN® (commercially available cationic liposomes comprising DOTMA and 1,2-dioleoyl-sn-3phosphoethanolamine (DOPE), from GIBCO/BRL, Grand Island, N.Y.); LIPOFECTAMINE® (commercially available cationic liposomes comprising N-(1-(2,3dioleyloxy)propyl)-N-(2-(sperminecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.). The following lipids are cationic and have a positive charge at below physiological pH: DODAP, DODMA, DMDMA, 1,2-dilinoleyloxy-N,N-dimethylaminopropane (DLinDMA), 1,2-dilinolenyloxy-N,N-dimethylaminopropane (DLenDMA).

The further cationic lipid may also be an amino lipid. Representative amino lipids include, but are not limited to, 1,2-dilinoleyoxy-3-(dimethylamino)acetoxypropane (DLinDAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA.Cl), 1,2-dilinoleoyl-3-trimethylaminopropane chloride salt (DLin-TAP.Cl), 1,2-dilinoleyloxy-3-(N-methylpiperazino)propane (DLin-MPZ), 3-(N, Ndilinoleylamino)-1,2-propanediol (DLinAP), 3-(N,N-dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[1,3]-dioxolane (DLin-KC2-DMA); dilinoleyl-methyl-4-dimethylaminobutyrate (DLin-MC3-DMA); MC3 (US20100324120).

Other suitable (cationic) lipids are disclosed in WO2009/086558, WO2009/127060, WO2010/048536, WO2010/054406, WO2010/088537, WO2010/129709, WO2011/153493, US2011/0256175, US2012/0128760, US2012/0027803, and U.S. Pat. No. 8,158,601. In that context, the disclosures of WO2009/086558, WO2009/127060, WO2010/048536, WO2010/054406, WO2010/088537, WO2010/129709, WO2011/153493, US2011/0256175, US2012/0128760, US2012/0027803, and U.S. Pat. No. 8,158,601 are incorporated herewith by reference.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the RNA which is used as cargo. The N/P ratio may be calculated on the basis that, for example, 1 µg RNA typically contains about 3 nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

In certain embodiments, the LNP comprises one or more additional lipids which stabilize the formation of particles during their formation.

Suitable stabilizing lipids include neutral lipids and anionic lipids. The term "neutral lipid" refers to any one of a number of lipid species that exist in either an uncharged or neutral zwitterionic form at physiological pH. Representative neutral lipids include diacylphosphatidylcholines, diacylphosphatidylethanolamines, ceramides, sphingomyelins, dihydro sphingomyelins, cephalins, and cerebrosides.

Exemplary neutral lipids include, for example, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidylethanol amine (SOPE), and 1,2-dielaidoyl-sn-glycero-3-phophoethanolamine (transDOPE). In one embodiment, the neutral lipid is 1,2-distearoyl-sn-glycero-3phosphocholine (DSPC).

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

LNP in vivo characteristics and behavior can be modified by addition of a hydrophilic polymer coating, e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids).

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

In certain embodiments, the LNP comprises an additional, stabilizing-lipid which is a polyethylene glycol-lipid (PEGylated lipid). Suitable polyethylene glycol-lipids include PEG-modified phosphatidylethanolamine, PEG-modified phosphatidic acid, PEG-modified ceramides (e.g. PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the polyethylene glycol-lipid is N-[(methoxy poly(ethylene glycol)2000)carbamyl]-1,2-dimyristyloxlpropyl-3-amine (PEG-c-DMA). In one embodiment, the polyethylene glycol-lipid is PEG-c-DOMG). In other embodiments, the LNPs comprise a PEGylated diacylglycerol (PEG-DAG) such as 1-(monomethoxy-polyethyleneglycol)-2,3-dimyristoylglycerol (PEG-DMG), a PEGylated phosphatidylethanoloamine (PEG-PE), a PEG succinate diacylglycerol (PEG-S-DAG) such as 4-O-(2',3'-di(tetradecanoyloxy)propyl-1-O-(ω-methoxy(polyethoxy)ethyl)butanedioate (PEG-S-DMG), a PEGylated ceramide (PEG-cer), or a PEG dialkoxypropylcarbamate such as ω-methoxy(polyethoxy)ethyl-N-(2,3-di(tetradecanoxy)propyl)carbamate or 2,3-di(tetradecanoxy)propyl-N-(ω-methoxy(polyethoxy)ethyl)carbamate.

Further examples of PEG-lipids suitable in that context are provided in US20150376115A1 and WO2015199952, each of which is incorporated by reference in its entirety.

In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2.5%, about 2%, about 1.5%, about 1%, about 0.5%, or about 0.3% on a molar basis (based on 100% total moles of lipids in the LNP).

In various embodiments, the molar ratio of the cationic lipid to the PEGylated lipid ranges from about 100:1 to about 25:1.

The total amount of nucleic acid, particularly the RNA in the lipid nanoparticles varies and may be defined depending on the e.g. RNA to total lipid w/w ratio. In one embodiment of the invention the RNA to total lipid ratio is less than 0.06 w/w, preferably between 0.03 w/w and 0.04 w/w.

In a preferred embodiment, the composition according to the invention comprises the nucleic acid comprising at least one nucleic acid sequence according to the invention that is formulated together with a cationic or polycationic compound and/or with a polymeric carrier. Accordingly, in a further embodiment of the invention, it is preferred that the nucleic acid as defined herein or any other nucleic acid comprised in the inventive (pharmaceutical) composition or vaccine is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of mRNA or nucleic acid to cationic or polycationic compound and/or with a polymeric carrier; or optionally in a nitrogen/phosphate (N/P) ratio of mRNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one mRNA to the one or more polycations is in the range of about 0.1 to 10, including a range of about 0.3 to 4, of about 0.5 to 2, of about 0.7 to 2 and of about 0.7 to 1.5.

Therein, the nucleic acid as defined herein or any other nucleic acid comprised in the (pharmaceutical) composition or vaccine according to the invention can also be associated with a vehicle, transfection or complexation agent for increasing the transfection efficiency and/or the immunostimulatory properties of the nucleic acid according to the invention or of optionally comprised further included nucleic acids.

Cationic or polycationic compounds, being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, plsl, FGF, Lactoferrin, Transportan, Buforin-2, Bac715-24, SynB, SynB(1), pVEC, hCT-derived peptides, SAP, or histones. More preferably, the mRNA according to the invention is complexed with one or more polycations, preferably with protamine or oligofectamine, most preferably with protamine. In this context protamine is particularly preferred.

Additionally, preferred cationic or polycationic proteins or peptides may be selected from the following proteins or peptides having the following total formula (III):

$$(Arg)_l;(Lys)_m;(His)_n;(Orn)_o;(Xaa)_x, \quad \text{(formula (III))}$$

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. Arg7, Arg8, Arg9, H3R9, R9H3, H3R9H3, YSSR9SSY, (RKH)4, Y(RKH)2R, etc. In this context the disclosure of WO 2009/030481 is incorporated herewith by reference.

Preferred cationic or polycationic proteins or peptides may be derived from formula Cys{(Arg)$_l$; (Lys)m; (His)$_n$; (Orn)$_o$; (Xaa)$_x$}Cys or {(Arg)$_l$; (Lys)$_m$; (His)$_n$; (Orn)$_o$; (Xaa)$_x$} of the patent application WO2009/030481 or WO2011/026641, the disclosure of WO2009/030481 and WO2011/026641 relating thereto are incorporated herewith by reference. In a preferred embodiment, the cationic or polycationic proteins or peptides comprises CHHHHHHRRRRHHHHHHC (SEQ ID NO: 309), CR$_{12}$C (SEQ ID NO: 306), CR$_{12}$ (SEQ ID NO: 307) or WR$_{12}$C (SEQ ID NO: 308).

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl) diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

According to a preferred embodiment, the composition of the present invention comprises the nucleic acid as defined herein, preferably an RNA, and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable of complexing the mRNA as defined herein or a further nucleic acid comprised in the composition, and thereby preferably condensing the mRNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the mRNA according to the invention or any further nucleic acid comprised in the (pharmaceutical) composition or vaccine of the present invention contains at least one —SH moiety, most preferably at least one cysteine residue or any further chemical group exhibiting an —SH moiety, capable of forming a disulfide linkage upon condensation with at least one further cationic or polycationic protein, peptide or polymer as cationic component of the polymeric carrier as mentioned herein.

As defined above, the polymeric carrier, which may be used to complex the nucleic acid of the present invention or any further nucleic acid comprised in the (pharmaceutical) composition or vaccine according to the invention may be formed by disulfide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined herein for complexation agent.

In a further particular embodiment, the polymeric carrier which may be used to complex the nucleic acid as defined herein or any further nucleic acid comprised in the (pharmaceutical) composition or vaccine according to the invention may be selected from a polymeric carrier molecule according to generic formula (IV):

$$L\text{-}P^1\text{—}S\text{—}[S\text{—}P^2\text{—}S]_n\text{—}S\text{—}P^3\text{-}L \qquad \text{formula (IV)}$$

wherein, $P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), (AA)$_x$, or [(AA)$_x$]$_z$ if such components are used as a linker between $P^1$ and $P^2$ or $P^3$ and $P^2$) and/or with further components (e.g. (AA), (AA)$_x$, [(AA)$_x$]$_z$ or L), the linear or branched hydrophilic polymer chain selected independent from each other from polyethylene glycol (PEG), poly-N-(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each $P^2$ exhibiting at least two —SH-moieties, capable to form a disulfide linkage upon condensation with further components $P^2$ or component(s) $P^1$ and/or $P^3$ or alternatively with further components (e.g. (AA), (AA)$_x$, or [(AA)$_x$]$_z$);

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components $P^1$ and $P^2$, $P^2$ and $P^2$, or $P^2$ and $P^3$, or optionally of further components as defined herein (e.g. L, (AA), (AA)$_x$, [(AA)$_x$]$_z$, etc); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/026641 is incorporated herewith by reference. Each of hydrophilic polymers P1 and P3 typically exhibits at least one —SH-moiety, wherein the at least one —SH-moiety is capable to form a disulfide linkage upon reaction with component P2 or with component (AA) or (AA)x, if used as linker between P1 and P2 or P3 and P2 as defined below and optionally with a further component, e.g. L and/or (AA) or (AA)x, e.g. if two or more —SH-moieties are contained. The following subformulae "P1-S—S—P2" and "P2-S—S—P3" within generic formula (IV) above (the brackets are omitted for better readability), wherein any of S, P1 and P3 are as defined herein, typically represent a situation, wherein one —SH-moiety of hydrophilic polymers P1 and P3 was condensed with one —SH-moiety of component P2 of generic formula (IV) above, wherein both sulphurs of these —SH-moieties form a disulfide bond —S—S— as defined herein in formula (IV). These —SH-moieties are typically provided by each of the hydrophilic polymers P1 and P3, e.g. via an internal cysteine or any further (modified) amino acid or compound which carries a —SH moiety. Accordingly, the subformulae "P1-S—S—P2" and "P2-S—S—P3" may also be written as "P1-Cys-Cys-P2" and "P2-Cys-Cys-P3", if the —SH— moiety is provided by a cysteine, wherein the term "Cys-Cys" represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "—Cys-S" indicate a disulfide bond between a —SH containing moiety and a cysteine, which may also be written as "—S—(S-Cys)" and "-(Cys-S)—S". Alternatively, the hydrophilic polymers P1 and P3 may be modified with a —SH moiety, preferably via a chemical reaction with a compound carrying a —SH moiety, such that each of the hydrophilic polymers P1 and P3 carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers P1 and P3 as defined herein. Such non-amino compounds may be attached to the hydrophilic polymers P1 and P3 of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsatured carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow Sn-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers P1 and P3. As defined herein, each of hydrophilic polymers P1 and P3 typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or (AA)x, antibodies, cell penetrating peptides or enhancer peptides (e.g. TAT, KALA), etc.

In a particularly preferred embodiment, the polymeric carrier is a peptide polymer, preferably a polyethylene glycol/peptide polymer comprising HO-PEG$_{5000}$-S—(S—CHHHHHHRRRRHHHHHC—S—)$_7$—S-PEG$_{5000}$-OH (peptide monomer: SEQ ID NO: 309) and a lipid component, preferably a lipidoid component, more preferably lipidoid 3-C12-OH.

The lipidoid 3-C12-OH

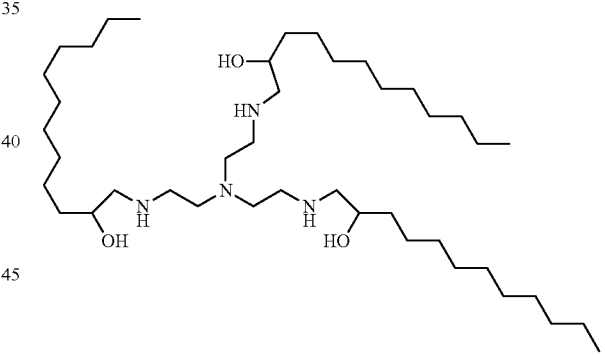

(as shown above) may be obtained by acylation of tris(2-aminoethyl)amine with an activated lauric (C12) acid derivative, followed by reduction of the amide. Alternatively, it may be prepared by reductive amination with the corresponding aldehyde. Lipidoid 3-C12-OH is prepared by addition of the terminal C12 alkyl epoxide with the same oligoamine according to Love et al., pp. 1864-1869, PNAS, vol. 107 (2010), no. 5 (cf. compound C12 and compound 110 in FIG. 1 of Love et al.). In preferred embodiments, the peptide polymer comprising lipidoid 3-C12-OH as specified above is used to complex the artificial nucleic acid of the invention, in particular RNA, to form complexes having an N/P ratio from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the artificial nucleic acid.

In another embodiment, the polymeric carrier comprises a lipidoid compound according to formula Ia

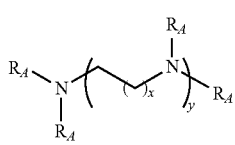
(formula Ia)

wherein
R$_A$ is independently selected for each occurrence an unsubstituted, cyclic or acyclic, branched or unbranched C$_{1-20}$ aliphatic group; a substituted or unsubstituted, cyclic or acyclic, branched or unbranched C$_{1-20}$ heteroaliphatic group; a substituted or unsubstituted aryl; a substituted or unsubstituted heteroaryl;

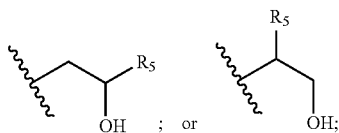

wherein at least one R$_A$ is

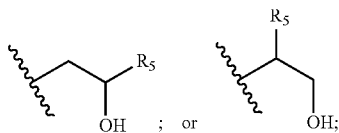

R$_5$ is independently selected for each occurrence of from an unsubstituted, cyclic or acyclic, branched or unbranched C$_{8-16}$ aliphatic; a substituted or unsubstituted aryl; or a substituted or unsubstituted heteroaryl;
each occurrence of x is an integer from 1 to 10;
each occurrence of y is an integer from 1 to 10;
or a pharmaceutically acceptable salt thereof.

In that context, the disclosure of the PCT patent application PCT/EP2017/064059 is herewith incorporated by reference.

In other embodiments, the composition, which is preferably a (pharmaceutical) composition comprises at least one artificial nucleic acid as described herein, wherein the at least one artificial nucleic acid is complexed or associated with polymeric carriers and, optionally, with at least one lipid component as described in the PCT applications PCT/EP2017/064065, PCT/EP2017/064058. In this context, the disclosures of PCT/EP2017/064065, and PCT/EP2017/064058 is herewith incorporated by reference.

Preferably, the inventive composition comprises at least one nucleic acid as defined herein, which is complexed with one or more polycations, and at least one free nucleic acid, wherein the at least one complexed nucleic acid is preferably identical to the at least one free nucleic acid. In this context, it is particularly preferred that the composition of the present invention comprises the nucleic acid, preferably the RNA, according to the invention that is complexed at least partially with a cationic or polycationic compound and/or a polymeric carrier, preferably cationic proteins or peptides. In this context, the disclosure of WO 2010/037539 and WO 2012/113513 is incorporated herewith by reference. Partially means that only a part of the nucleic acid as defined herein is complexed in the composition according to the invention with a cationic compound and that the rest of the nucleic acid as defined herein is (comprised in the inventive (pharmaceutical) composition or vaccine) in uncomplexed form ("free"). Preferably, the molar ratio of the complexed nucleic acid to the free nucleic acid is selected from a molar ratio of about 0.001:1 to about 1:0.001, including a ratio of about 1:1. More preferably the ratio of complexed nucleic acid to free nucleic acid (in the (pharmaceutical) composition or vaccine of the present invention) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed nucleic acid to free nucleic acid in the inventive pharmaceutical composition or vaccine is selected from a ratio of about 1:1 (w/w).

The complexed nucleic acid in the (pharmaceutical) composition or vaccine according to the present invention, is preferably prepared according to a first step by complexing the nucleic acid according to the invention with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed nucleic acid after complexing the nucleic acid. Accordingly, the ratio of the nucleic acid and the cationic or polycationic compound and/or the polymeric carrier in the component of the complexed RNA is typically selected in a range so that the nucleic acid is entirely complexed and no free cationic or polycationic compound or polymeric carrier or only a negligibly small amount thereof remains in the composition.

Preferably the ratio of the nucleic acid, preferably the RNA as defined herein to the cationic or polycationic compound and/or the polymeric carrier, preferably as defined herein, is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w). Alternatively, the ratio of the nucleic acid as defined herein to the cationic or polycationic compound and/or the polymeric carrier, preferably as defined herein, in the component of the complexed nucleic acid, may also be calculated on the basis of the nitrogen/phosphate ratio (N/P-ratio) of the entire complex. In the context of the present invention, an N/P-ratio is preferably in the range of about 0.1-10, preferably in a range of about 0.3-4 and most preferably in a range of about 0.5-2 or 0.7-2 regarding the ratio of mRNA:cationic or polycationic compound and/or polymeric carrier, preferably as defined herein, in the complex, and most preferably in a range of about 0.7-1.5, 0.5-1 or 0.7-1, and even most preferably in a range of about 0.3-0.9 or 0.5-0.9, preferably provided that the cationic or polycationic compound in the complex is a cationic or polycationic cationic or polycationic protein or peptide and/or the polymeric carrier as defined above. In this specific embodiment the complexed mRNA as defined herein is also encompassed in the term "adjuvant component".

In other embodiments, the composition according to the invention comprising the nucleic acid, preferably the mRNA as defined herein may be administered naked without being associated with any further vehicle, transfection or complexation agent.

It has to be understood and recognized, that according to the present invention, the inventive composition may comprise at least one naked nucleic acid, particularly naked mRNA as defined herein and/or at least one formulated/complexed mRNA as defined herein, wherein every formulation and/or complexation as disclosed above may be used.

Adjuvants:

According to another embodiment, the (pharmaceutical) composition or vaccine according to the invention may comprise an adjuvant, which is preferably added in order to enhance the immunostimulatory properties of the composition. In this context, an adjuvant may be understood as any compound, which is suitable to support administration and delivery of the composition according to the invention. Furthermore, such an adjuvant may, without being bound thereto, initiate or increase an immune response of the innate immune system, i.e. a non-specific immune response. In other words, when administered, the composition according to the invention typically initiates an adaptive immune response due to an NIPAH virus antigen as defined herein or a fragment or variant thereof, which is encoded by the at least one coding sequence of the inventive mRNA contained in the composition of the present invention. Additionally, the composition according to the invention may generate an (supportive) innate immune response due to addition of an adjuvant as defined herein to the composition according to the invention.

Such an adjuvant may be selected from any adjuvant known to a skilled person and suitable for the present case, i.e. supporting the induction of an immune response in a mammal. Preferably, the adjuvant may be selected from the group consisting of, without being limited thereto, TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl-dodecanoyl-amide hydroacetate); CALCITRIOL™ (1-alpha,25-dihydroxy-vitamin D3); calcium phosphate gel; CAP™ (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i) N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L-alanyl-D-isoglutamine); imiquimod (1-(2-methypropyl)-1H-imidazo[4,5-c]quinoline-4-amine); ImmTherm™ (N-acetylglucosaminyl-N-acetylmuramyl-L-Ala-D-isoGlu-L-Ala-glycerol dipalmitate); DRVs (immunoliposomes prepared from dehydration-rehydration vesicles); interferon-gamma; interleukin-1beta; interleukin-2; interleukin-7; interleukin-12; ISCOMS™; ISCOPREP 7.0.3.™; liposomes; LOXORIBINE™ (7-allyl-8-oxoguanosine); LT oral adjuvant (*E. coli* labile enterotoxin-protoxin); microspheres and microparticles of any composition; MF59™; (squalene-water emulsion); MONTANIDE ISA 51™ (purified incomplete Freund's adjuvant); MONTANIDE ISA 720™ (metabolisable oil adjuvant); MPL™ (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (β-glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULON™ (QS-21); Quil-A (Quil-A saponin); S-28463 (4-amino-otec-dimethyl-2-ethoxymethyl-1H-imidazo[4,5 c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethyltetracosan and 2,6,10,15,19,23-hexamethyl-2,6,10,14,18,22-tetracosahexane); stearyltyrosine (octadecyltyrosine hydrochloride); Theramid® (N-acetylglucosaminyl-N-acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Particularly preferred, an adjuvant may be selected from adjuvants, which support induction of a Th1-immune response or maturation of naïve T-cells, such as GM-CSF, IL-12, IFNγ, any immunostimulatory nucleic acid as defined above, preferably an immunostimulatory RNA, CpG DNA, etc.

In a further preferred embodiment it is also possible that the inventive composition contains besides the antigen-providing nucleic acid as disclosed herein further components which are selected from the group comprising: further antigens (e.g. in the form of a peptide or protein) or further antigen-encoding nucleic acids; a further immunotherapeutic agent; one or more auxiliary substances; or any further compound, which is known to be immune stimulating due to its binding affinity (as ligands) to human Toll-like receptors; and/or an adjuvant nucleic acid, preferably an immunostimulatory RNA (isRNA).

The composition of the present invention can additionally contain one or more auxiliary substances in order to increase its immunogenicity or immunostimulatory capacity, if desired. A synergistic action of the nucleic acid or preferably the mRNA as defined herein and of an auxiliary substance, which may be optionally contained in the inventive composition, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response to be enhanced and/or influenced in a targeted manner. Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta or TNF-alpha, growth factors, such as hGH.

Suitable adjuvants may also be selected from cationic or polycationic compounds wherein the adjuvant is preferably prepared upon complexing the mRNA of the composition according to the invention with the cationic or polycationic compound. Associating or complexing the mRNA of the composition with cationic or polycationic compounds as defined herein preferably provides adjuvant properties and confers a stabilizing effect to the mRNA of the composition. In particular, such preferred cationic or polycationic compounds are selected from cationic or polycationic peptides or proteins, including protamine, nucleoline, spermin or spermidine, or other cationic peptides or proteins, such as poly-L-lysine (PLL), poly-arginine, basic polypeptides, cell penetrating peptides (CPPs), including HIV-binding peptides, Tat, HIV-1 Tat (HIV), Tat-derived peptides, Penetratin, VP22 derived or analog peptides, HSV VP22 (Herpes simplex), MAP, KALA or protein transduction domains (PTDs, PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, plsl, FGF, Lactoferrin, Transportan, Buforin-2, Bac715-24, SynB, SynB(1), pVEC, hCT-derived peptides, SAP, protamine, spermine, spermidine, or histones. Further preferred cationic or polycationic compounds may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl]-trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified Amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, Chitosan, etc., silan backbone based polymers, such as PMOXA-PDMS copolymers, etc., blockpolymers consisting of a combination of one or more cationic blocks (e.g. selected of a cationic polymer as mentioned above) and of one or more hydrophilic- or hydrophobic blocks (e.g polyethyleneglycole); etc.

Additionally, preferred cationic or polycationic proteins or peptides, which can be used as an adjuvant by complexing the mRNA of the composition according to the invention, may be selected from following proteins or peptides having the following total formula (III): $(Arg)_l$; $(Lys)_m$; $(His)_n$; $(Orn)_o$; $(Xaa)_x$, wherein $l+m+n+o+x=8-15$, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred oligoarginines in this context are e.g. Arg7, Arg8, Arg9, Arg7, H3R9, R9H3, H3R9H3, YSSR9SSY, (RKH)4, Y(RKH)2R, etc.

The ratio of the nucleic acid, particularly of mRNA to the cationic or polycationic compound in the adjuvant component may be calculated on the basis of the nitrogen/phosphate ratio (N/P-ratio) of the entire mRNA complex, i.e. the ratio of positively charged (nitrogen) atoms of the cationic or polycationic compound to the negatively charged phosphate atoms of the nucleic acids. For example, 1 µg of RNA typically contains about 3 nmol phosphate residues, provided the RNA exhibits a statistical distribution of bases. Additionally, 1 µg of peptide typically contains about x nmol nitrogen residues, dependent on the molecular weight and the number of basic amino acids. When exemplarily calculated for (Arg)9 (molecular weight 1424 g/mol, 9 nitrogen atoms), 1 µg (Arg)9 contains about 700 pmol (Arg)9 and thus 700×9=6300 pmol basic amino acids=6.3 nmol nitrogen atoms. For a mass ratio of about 1:1 RNA/(Arg)9 an N/P ratio of about 2 can be calculated. When exemplarily calculated for protamine (molecular weight about 4250 g/mol, 21 nitrogen atoms, when protamine from salmon is used) with a mass ratio of about 2:1 with 2 µg RNA, 6 nmol phosphate are to be calculated for the RNA; 1 µg protamine contains about 235 pmol protamine molecules and thus 235×21=4935 pmol basic nitrogen atoms=4.9 nmol nitrogen atoms. For a mass ratio of about 2:1 RNA/protamine an N/P ratio of about 0.81 can be calculated. For a mass ratio of about 8:1 RNA/protamine an N/P ratio of about 0.2 can be calculated. In the context of the present invention, an N/P-ratio is preferably in the range of about 0.1-10, preferably in a range of about 0.3-4 and most preferably in a range of about 0.5-2 or 0.7-2 regarding the ratio of RNA:peptide in the complex, and most preferably in the range of about 0.7-1.5.

In a preferred embodiment, the composition of the present invention is obtained in two separate steps in order to obtain both, an efficient immunostimulatory effect and efficient translation of the nucleic acid, particularly the mRNA according to the invention. Therein, a so called "adjuvant component" is prepared by complexing—in a first step—an mRNA as defined herein of the adjuvant component with a cationic or polycationic compound in a specific ratio to form a stable complex. In this context, it is important, that no free cationic or polycationic compound or only a negligibly small amount remains in the adjuvant component after complexing the mRNA. Accordingly, the ratio of the mRNA and the cationic or polycationic compound in the adjuvant component is typically selected in a range that the mRNA is entirely complexed and no free cationic or polycationic compound or only a negligible small amount remains in the composition. Preferably the ratio of the adjuvant component, i.e. the ratio of the mRNA to the cationic or polycationic compound is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

According to a preferred embodiment, the nucleic acid, particularly the mRNA of the invention comprising at least one mRNA sequence comprising at least one coding region as defined herein is added in a second step to the complexed mRNA of the adjuvant component in order to form the (immunostimulatory) composition of the invention. Therein, the mRNA of the composition according to the invention is added as free mRNA, which is not complexed by other compounds. Prior to addition, the free mRNA is not complexed and will preferably not undergo any detectable or significant complexation reaction upon the addition of the adjuvant component. This is due to the strong binding of the cationic or polycationic compound to the above described mRNA according to the invention comprised in the adjuvant component. In other words, when the mRNA comprising at least one coding region as defined herein is added to the "adjuvant component", preferably no free or substantially no free cationic or polycationic compound is present, which could form a complex with the free mRNA. Accordingly, an efficient translation of the mRNA of the composition is possible in vivo. Therein, the free mRNA, may occur as a mono-, di-, or multicistronic mRNA, i.e. an mRNA which carries the coding sequences of one or more proteins. Such coding sequences in di-, or even multicistronic mRNA may be separated by at least one IRES sequence, e.g. as defined herein.

In a particularly preferred embodiment, the free nucleic acid, particularly the mRNA as defined herein, which is comprised in the composition of the present invention, may be identical or different to the RNA as defined herein, which is comprised in the adjuvant component of the composition, depending on the specific requirements of therapy. Even more preferably, the free RNA, which is comprised in the composition according to the invention, is identical to the RNA of the adjuvant component of the inventive composition.

In a particularly preferred embodiment, the composition according to the invention comprises the nucleic acid, particularly the mRNA of the invention, which encodes at least one NIPAH virus antigenic peptide or protein as defined herein and wherein said mRNA is present in the composition partially as free mRNA and partially as complexed mRNA. Preferably, the mRNA as defined herein is complexed as described above and the same mRNA is then added as free mRNA, wherein preferably the compound, which is used for complexing the mRNA is not present in free form in the composition at the moment of addition of the free mRNA component.

The ratio of the first component (i.e. the adjuvant component comprising or consisting of the nucleic acid, particularly the mRNA as defined herein complexed with a cationic or polycationic compound) and the second component (i.e. the free mRNA as defined herein) may be selected in the inventive composition according to the specific requirements of a particular therapy. Typically, the ratio of the mRNA in the adjuvant component and the at least one free mRNA (mRNA in the adjuvant component:free mRNA) of the composition according to the invention is selected such that a significant stimulation of the innate immune system is elicited due to the adjuvant component. In parallel, the ratio is selected such that a significant amount of the free mRNA can be provided in vivo leading to an efficient translation and concentration of the expressed protein in vivo, e.g. the at least one NIPAH virus antigenic peptide or protein as defined herein. Preferably the ratio of the mRNA in the adjuvant component:free mRNA in the inventive composition is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of mRNA in the adjuvant component: free mRNA in the inventive composition is selected from a ratio of about 1:1 (w/w).

Additionally or alternatively, the ratio of the first component (i.e. the adjuvant component comprising or consisting of the nucleic acid, particularly the mRNA complexed with a cationic or polycationic compound) and the second component (i.e. the free mRNA) may be calculated on the basis of the nitrogen/phosphate ratio (N/P-ratio) of the entire mRNA complex. In the context of the present invention, an N/P-ratio is preferably in the range of about 0.1-10, preferably in a range of about 0.3-4 and most preferably in a range of about 0.5-2 or 0.7-2 regarding the ratio of mRNA:peptide in the complex, and most preferably in the range of about 0.7-1.5.

Additionally or alternatively, the ratio of the first component (i.e. the adjuvant component comprising or consisting of the nucleic acid, particularly the mRNA complexed with a cationic or polycationic compound) and the second component (i.e. the free mRNA) may also be selected in the composition according to the invention on the basis of the molar ratio of both mRNAs to each other, i.e. the mRNA of the adjuvant component, being complexed with a cationic or polycationic compound and the free mRNA of the second component. Typically, the molar ratio of the mRNA of the adjuvant component to the free mRNA of the second component may be selected such, that the molar ratio suffices the above (w/w) and/or N/P-definitions. More preferably, the molar ratio of the mRNA of the adjuvant component to the free mRNA of the second component may be selected e.g. from a molar ratio of about 0.001:1, 0.01:1, 0.1:1, 0.2:1, 0.3:1, 0.4:1, 0.5:1, 0.6:1, 0.7:1, 0.8:1, 0.9:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.001:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.9 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.9:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, or a range of about 0.01:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, etc.

Even more preferably, the molar ratio of the nucleic acid, particularly the mRNA of the adjuvant component to the free mRNA of the second component may be selected e.g. from a range of about 0.01:1 to 1:0.01. Most preferably, the molar ratio of the mRNA of the adjuvant component to the free mRNA of the second component may be selected e.g. from a molar ratio of about 1:1. Any of the above definitions with regard to (w/w) and/or N/P ratio may also apply.

Suitable adjuvants may furthermore be selected from nucleic acids having the formula (Va): GlXmGn, wherein: G is guanosine, uracil or an analogue of guanosine or uracil; X is guanosine, uracil, adenosine, thymidine, cytosine or an analogue of the above-mentioned nucleotides; l is an integer from 1 to 40, wherein when l=1 G is guanosine or an analogue thereof, when l>1 at least 50% of the nucleotides are guanosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 G is guanosine or an analogue thereof, when n>1 at least 50% of the nucleotides are guanosine or an analogue thereof, or formula (Vb): (NuGlXmGnNv)a, wherein: G is guanosine (guanine), uridine (uracil) or an analogue of guanosine (guanine) or uridine (uracil), preferably guanosine (guanine) or an analogue thereof; X is guanosine (guanine), uridine (uracil), adenosine (adenine), thymidine (thymine), cytidine (cytosine), or an analogue of these nucleotides (nucleosides), preferably uridine (uracil) or an analogue thereof; N is a nucleic acid sequence having a length of about 4 to 50, preferably of about 4 to 40, more preferably of about 4 to 30 or 4 to 20 nucleic acids, each N independently being selected from guanosine (guanine), uridine (uracil), adenosine (adenine), thymidine (thymine), cytidine (cytosine) or an analogue of these nucleotides (nucleosides); a is an integer from 1 to 20, preferably from 1 to 15, most preferably from 1 to 10; l is an integer from 1 to 40, wherein when l=1, G is guanosine (guanine) or an analogue thereof, when l>1, at least 50% of these nucleotides (nucleosides) are guanosine (guanine) or an analogue thereof; m is an integer and is at least 3; wherein when m=3, X is uridine (uracil) or an analogue thereof, and when m>3, at least 3 successive uridines (uracils) or analogues of uridine (uracil) occur; n is an integer from 1 to 40, wherein when n=1, G is guanosine (guanine) or an analogue thereof, when n>1, at least 50% of these nucleotides (nucleosides) are guanosine (guanine) or an analogue thereof; u,v may be independently from each other an integer from 0 to 50, preferably wherein when u=0, v≥1, or when v=0, u≥1; wherein the nucleic acid molecule of formula (Vb) has a length of at least 50 nucleotides, preferably of at least 100 nucleotides, more preferably of at least 150 nucleotides, even more preferably of at least 200 nucleotides and most preferably of at least 250 nucleotides.

Other suitable adjuvants may furthermore be selected from nucleic acids having the formula (VI): ClXmCn, wherein: C is cytosine, uracil or an analogue of cytosine or uracil; X is guanosine, uracil, adenosine, thymidine, cytosine or an analogue of the above-mentioned nucleotides; l is an integer from 1 to 40, wherein when l=1 C is cytosine or an analogue thereof, when l>1 at least 50% of the nucleotides are cytosine or an analogue thereof; m is an integer and is at least 3; wherein when m=3 X is uracil or an analogue thereof, when m>3 at least 3 successive uracils or analogues of uracil occur; n is an integer from 1 to 40, wherein when n=1 C is cytosine or an analogue thereof, when n>1 at least 50% of the nucleotides are cytosine or an analogue thereof.

In this context the disclosure of WO2008014979 and WO2009095226 is also incorporated herein by reference.

Vaccine:

In a further aspect, the present invention provides a vaccine, which is based on the nucleic acid, particularly the mRNA sequence according to the invention comprising at least one coding region as defined herein. The vaccine according to the invention is preferably a (pharmaceutical) composition as defined herein.

The vaccine according to the invention is based on the same components as the (pharmaceutical) composition described herein. Insofar, it may be referred to the description of the (pharmaceutical) composition as provided herein. Preferably, the vaccine according to the invention comprises at least one nucleic acid comprising at least one nucleic acid sequence as defined herein and a pharmaceutically acceptable carrier. In embodiments, where the vaccine comprises more than one nucleic acid, particularly more than one mRNA sequence (such as a plurality of RNA sequences according to the invention, wherein each preferably encodes a distinct antigenic peptide or protein), the vaccine may be provided in physically separate form and may be administered by separate administration steps. The vaccine according to the invention may correspond to the (pharmaceutical) composition as described herein, especially where the mRNA sequences are provided by one single composition. However, the inventive vaccine may also be provided physically separated. For instance, in embodiments, wherein the vaccine comprises more than one mRNA sequences/species, these RNA species may be provided such that, for example, two, three, four, five or six separate compositions, which may contain at least one mRNA species/sequence each (e.g, three distinct mRNA species/sequences), each encoding distinct antigenic peptides or proteins, are provided, which may or may not be combined. Also, the inventive vaccine may be a combination of at least two distinct compositions, each composition comprising at least one mRNA encoding at least one of the antigenic peptides or proteins defined herein. Alternatively, the vaccine may be provided as a combination of at least one mRNA, preferably at least two, three, four, five, six or more mRNAs, each encoding one of the antigenic peptides or proteins defined herein. The vaccine may be combined to provide one single composition prior to its use or it may be used such that more than one administration is required to administer the distinct mRNA sequences/species encoding any of the antigenic peptides or proteins as defined herein. If the vaccine contains at least one mRNA sequence, typically at least two mRNA sequences, encoding the antigen combinations defined herein, it may e.g. be administered by one single administration (combining all mRNA species/sequences), by at least two separate administrations. Accordingly, any combination of mono-, bi- or multicistronic mRNAs encoding the at least one antigenic peptide or protein or any combination of antigens as defined herein (and optionally further antigens), provided as separate entities (containing one mRNA species) or as combined entity (containing more than one mRNA species), is understood as a vaccine according to the present invention.

As with the (pharmaceutical) composition according to the present invention, the entities of the vaccine may be provided in liquid and or in dry (e.g. lyophilized) form. They may contain further components, in particular further components allowing for its pharmaceutical use. The vaccine or the (pharmaceutical) composition may, e.g., additionally contain a pharmaceutically acceptable carrier and/or further auxiliary substances and additives and/or adjuvants.

The vaccine or (pharmaceutical) composition typically comprises a safe and effective amount of the nucleic acid, particularly mRNA according to the invention as defined herein, encoding an antigenic peptide or protein as defined herein or a fragment or variant thereof or a combination of antigens, preferably as defined herein. As used herein, "safe and effective amount" means an amount of the mRNA that is sufficient to significantly induce a positive modification of cancer or a disease or disorder related to cancer. At the same time, however, a "safe and effective amount" is small enough to avoid serious side-effects, that is to say to permit a sensible relationship between advantage and risk. The determination of these limits typically lies within the scope of sensible medical judgment. In relation to the vaccine or (pharmaceutical) composition of the present invention, the expression "safe and effective amount" preferably means an amount of the mRNA (and thus of the encoded virus antigen) that is suitable for stimulating the adaptive immune system in such a manner that no excessive or damaging immune reactions are achieved but, preferably, also no such immune reactions below a measurable level. Such a "safe and effective amount" of the mRNA of the (pharmaceutical) composition or vaccine as defined herein may furthermore be selected in dependence of the type of mRNA, e.g. mono-cistronic, bi- or even multicistronic mRNA, since a bi- or even multicistronic mRNA may lead to a significantly higher expression of the encoded virus antigen(s) than the use of an equal amount of a monocistronic mRNA. A "safe and effective amount" of the mRNA of the (pharmaceutical) composition or vaccine as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The vaccine or composition according to the invention can be used according to the invention for human and also for veterinary medical purposes (mammals, vertebrates), as a pharmaceutical composition or as a vaccine.

In a preferred embodiment, the artificial nucleic acid, vaccine or composition according to the invention is used as pharmaceutical composition or as a vaccine in the prophylaxis or treatment of disorders related to Henipavirus and/or Nipah virus and/or Hendra virus in mammals, wherein the mammal may be selected from canines (e.g., dogs), felines (e.g., cats), equines (e.g., horses), bovines (e.g., cattle) porcine (e.g., pigs), as well as bats, flying foxes, rodents etc.

In a preferred embodiment, the nucleic acid, particularly the mRNA of the (pharmaceutical) composition, vaccine or kit of parts according to the invention is provided in lyophilized form. Preferably, the lyophilized mRNA is reconstituted in a suitable buffer, advantageously based on an aqueous carrier, prior to administration, e.g. Ringer-Lactate solution, which is preferred, Ringer solution, a phosphate buffer solution. In a preferred embodiment, the (pharmaceutical) composition, the vaccine or the kit of parts according to the invention contains at least one, two, three, four, five, six or more mRNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) mRNAs.

The vaccine or (pharmaceutical) composition according to the invention may typically contain a pharmaceutically acceptable carrier. The expression "pharmaceutically acceptable carrier" as used herein preferably includes the liquid or non-liquid basis of the inventive vaccine. If the inventive vaccine is provided in liquid form, the carrier will be water, typically pyrogen-free water; isotonic saline or buffered (aqueous) solutions, e.g phosphate, citrate etc. buffered solutions. Particularly for injection of the inventive vaccine, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$), $CaI_2$, $CaBr_2$, $CaCO_3$, $CaSO_4$, $Ca(OH)_2$. Furthermore, organic anions of the aforementioned cations may be contained in the buffer. According to a more preferred embodiment, the buffer suitable for injection purposes as defined above, may contain salts selected from sodium chloride (NaCl), calcium chloride ($CaCl_2$)) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$)). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the inventive vaccine are capable of being mixed with the nucleic acid, particularly the mRNA according to the invention as defined herein, in such a manner that no interaction occurs, which would substantially reduce the pharmaceutical effectiveness of the inventive vaccine under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition or vaccine according to the invention is administered. The composition or vaccine can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, composition or vaccines according to the present invention may be administered by an intradermal, subcutaneous, or intramuscular route, preferably by injection, which may be needle-free and/or needle injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive composition or vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

The inventive vaccine or composition can additionally contain one or more auxiliary substances in order to further increase the immunogenicity. A synergistic action of the nucleic acid contained in the inventive composition and of an auxiliary substance, which may be optionally be co-formulated (or separately formulated) with the inventive vaccine or composition as described above, is preferably achieved thereby. Depending on the various types of auxiliary substances, various mechanisms may play a role in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response produced by the immune-stimulating adjuvant according to the invention to be enhanced and/or influenced in a targeted manner. Particularly preferred auxiliary substances are cytokines, such as monokines, lymphokines, interleukins or chemokines, that—additional to induction of the adaptive immune response by the encoded at least one antigen—promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta or TNF-alpha, growth factors, such as hGH. Preferably, such immunogenicity increasing agents or compounds are provided separately (not co-formulated with the inventive vaccine or composition) and administered individually.

Further additives which may be included in the inventive vaccine or composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

The inventive vaccine or composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive vaccine or composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

In a further aspect, the present invention concerns a polypeptide encoded by the inventive artificial nucleic acid as described herein, or a fragment of said polypeptide.

In a further aspect, the present invention provides a composition comprising at least one of the inventive polypeptides as described herein. In a preferred embodiment, the inventive composition comprises one type of polypeptide as described herein. Alternatively, the inventive composition may comprise at least two different inventive polypeptides as described herein.

In a preferred embodiment, the at least one of the inventive polypeptides comprises at least one protein or peptides according to SEQ ID NOs: 1-7, 12-18, 573-579, 584-590, 807-813, 818-824, 1041-1047, 1052-1058, 1513-1515 a fragment or variant thereof.

Preferably, the inventive composition comprises or consists of at least one of the inventive polypeptides described herein and a pharmaceutically acceptable carrier. In this context, the pharmaceutically acceptable carrier as well as optional further components of the composition preferably as described herein, with respect to the inventive composition, comprises at least one inventive artificial nucleic acid.

In another embodiment, the inventive composition comprises or consists of at least one of the inventive polypeptides described herein and a pharmaceutically acceptable carrier and at least one adjuvant.

In another embodiment, the inventive composition comprises or consists of at least one of the inventive polypeptides described herein and a pharmaceutically acceptable carrier and at least one adjuvant and at least one inventive nucleic acid as defined herein.

In a further aspect, the invention concerns a vaccine comprising the inventive composition comprising at least one of the polypeptides according to the invention. Therein, the at least one of the inventive polypeptides preferably elicits an adaptive immune response upon administration to a subject. More preferably, the vaccine according to the invention comprising at least one of the inventive polypeptides or the inventive composition comprising at least one of the polypeptides according to the invention is preferably a vaccine as described herein. Reference is made to the respective description herein.

As used herein, the term "inventive composition" may refer to the inventive composition comprising at least one artificial nucleic acid according to the invention. Likewise, the term "inventive vaccine", as used in this context, may refer to an inventive vaccine, which is based on the inventive artificial nucleic acid, i.e. which comprises at least one artificial nucleic acid according to the invention or which comprises the inventive composition comprising said artificial nucleic acid.

Kit:

According to another embodiment, the present invention also provides kits, particularly kits of parts, comprising the artificial nucleic acid according to the invention, the inventive composition comprising at least one artificial nucleic acid according to the invention, the inventive polypeptides as described herein, the inventive composition comprising at least one inventive polypeptide or the inventive vaccine as described herein, optionally a liquid vehicle for solubilising and optionally technical instructions with information on the administration and dosage of the artificial nucleic acid according as described herein, the inventive composition comprising at least one artificial nucleic acid according to the invention, the inventive polypeptides as described herein, the inventive composition comprising at least one inventive polypeptide or the inventive vaccine. The technical instructions may contain information about administration and dosage. Such kits, preferably kits of parts, may be applied e.g. for any of the applications or uses mentioned herein, preferably for the use of the artificial nucleic acid according as described herein, the inventive composition comprising at least one artificial nucleic acid according to the invention, the inventive polypeptides as described herein, the inventive composition comprising at least one inventive polypeptide or the inventive vaccine for the treatment or prophylaxis of a Henipvirus and/or a Nipah virus and/or a Hendra virus infection or diseases or disorders related thereto. The kits may also be applied for the use of the artificial nucleic acid according as described herein, the inventive composition comprising at least one artificial nucleic acid according to the invention, the inventive polypeptides as described herein, the inventive composition comprising at least one inventive polypeptide or the inventive vaccine for the treatment or prophylaxis of Henipvirus and/or a Nipah virus and/or a Hendra virus infection or diseases or disorders related thereto, wherein the artificial nucleic acid according as described herein, the inventive composition comprising at least one artificial nucleic acid according to the invention, the inventive polypeptides as described herein, the inventive composition comprising at least one inventive polypeptide or the inventive vaccine may induce or enhance an immune response in a mammal as defined above. Preferably, the artificial nucleic acid according as described herein, the inventive composition comprising at least one artificial nucleic acid according to the invention, or the inventive vaccine is provided in a separate part of the kit, wherein the artificial nucleic acid according as described herein, the inventive composition comprising at least one artificial nucleic acid according to the invention, or the inventive vaccine are preferably lyophilised. More preferably, the kit further contains as a part a vehicle for solubilising the artificial nucleic acid according as described herein, the inventive composition comprising at least one artificial nucleic acid according to the invention, or the inventive vaccine, the vehicle preferably being Ringer-lactate solution. Any of the above kits may be used in a treatment or prophylaxis as defined above. More preferably, any of the above kits may be used as a vaccine, preferably a vaccine against Henipvirus and/or a Nipah virus and/or a Hendra virus infection or a related disease or disorder.

Any of the above kits may be used in a treatment or prophylaxis as defined above. More preferably, any of the above kits may be used as a vaccine, preferably a vaccine against Henipvirus and/or a Nipah virus and/or a Hendra virus infection or a related disease or disorder.

Application and Medical Use:

According to one aspect of the present invention, the nucleic sequence, the (pharmaceutical) composition or the vaccine may be used according to the invention (for the preparation of a medicament) as a medicament.

The present invention furthermore provides several applications and uses of the artificial nucleic acid according to the invention, the inventive composition comprising at least one artificial nucleic acid according to the invention, the inventive polypeptides as described herein, the inventive composition comprising at least one inventive polypeptide or the inventive vaccine or of kits comprising same. In particular, the inventive (pharmaceutical) composition(s) or the inventive vaccine may be used for human and also for veterinary medical purposes, preferably for human medical purposes, as a pharmaceutical composition in general or as a vaccine.

In a further aspect, the invention provides the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for use in a method of prophylactic (pre-exposure prophylaxis or post-exposure prophylaxis) and/or therapeutic treatment of Henipvirus and/or a Nipah virus and/or a Hendra virus infections. Consequently, in a further aspect, the present invention is directed to the first medical use of the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts as defined herein as a medicament. Particularly, the invention provides the use of an artificial nucleic acid comprising at least one coding region encoding at least one polypeptide comprising at least one Henipvirus and/or a Nipah virus and/or a Hendra virus protein or peptide as defined herein, or a fragment or variant thereof as described herein for the preparation of a medicament.

According to another aspect, the present invention is directed to the second medical use of the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for the treatment of an infection with Henipvirus and/or a Nipah virus and/or a Hendra virus or a disease or disorders related to an infection with Henipvirus and/or a Nipah virus and/or a Hendra virus as defined herein.

Particularly, the artificial nucleic acid comprising at least one coding region encoding at least one polypeptide comprising at least one antigenic protein or peptide as defined herein, or a fragment or variant thereof as described herein to be used in a method as said above is an artificial nucleic acid formulated together with a pharmaceutically acceptable vehicle and an optionally additional adjuvant and an optionally additional further component as defined herein.

The invention provides the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts for medical use, in particular for the treatment of an infection with Henipvirus and/or a Nipah virus and/or a Hendra virus or a disease or disorders related to an infection with Henipvirus and/or a Nipah virus and/or a Hendra virus, wherein preferably an infection with Henipvirus and/or a Nipah virus and/or a Hendra virus may involve any Henipvirus and/or a Nipah virus and/or a Hendra virus as defined herein.

As used herein, "a disorder related to a Henipvirus and/or a Nipah virus and/or a Hendra virus infection" or "a disease related to a Henipvirus and/or a Nipah virus and/or a Hendra virus infection" may preferably comprise a complication of Henipvirus and/or a Nipah virus and/or a Hendra virus infection. Complications and disease related disorders associated with Nipah virus infection include fever and headache, followed by drowsiness, disorientation and mental confusion, respiratory illness and encephalitis (inflammation of the brain). Complications and disease related disorders associated with Hendra virus include various respiratory and neurologic complications and symptoms.

In a preferred embodiment, the inventive composition or vaccine is thus used for treatment or prophylaxis, preferably prophylaxis, of complications associated with a Nipah virus infection.

In a preferred embodiment, the inventive composition or vaccine is thus used for treatment or prophylaxis, preferably prophylaxis, of complications associated with a Hendra virus infection.

In a preferred embodiment, the inventive composition or vaccine is thus used for treatment or prophylaxis, preferably prophylaxis, of complications associated with a Henipavirus infection.

The inventive composition or the inventive vaccine, in particular the inventive composition comprising at least one artificial nucleic acid according to the invention, the inventive polypeptides as described herein or the inventive composition comprising at least one inventive polypeptide, can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, vaccines may be administered by an intradermal, subcutaneous, or intramuscular route. Inventive vaccines are therefore preferably formulated in liquid (or sometimes in solid) form. Preferably, the inventive vaccine may be administered by conventional needle injection or needle-free jet injection. In a preferred embodiment the inventive vaccine or composition may be administered by jet injection as defined herein, preferably intramuscularly or intradermally, more preferably intradermally.

In a preferred embodiment, a single dose of the inventive artificial nucleic acid, composition or vaccine comprises a specific amount of the artificial nucleic acid according to the invention.

In embodiments, the inventive artificial nucleic acid is provided in an amount of 5 µg, 10 µg, 15 µg, 20 µg, 25 µg, 30 µg, 35 µg, 40 µg, 45 µg, 50 µg, 60 µg, 70 µg, 80 µg, 90 µg, or 100 µg. Preferably, the inventive artificial nucleic acid is provided in an amount of at least 5 µg per dose, preferably in an amount of from 10 to 500 µg per dose, more preferably in an amount of from 20 to 200 µg per dose. More specifically, in the case of intradermal injection, which is preferably carried out by using a conventional needle, the amount of the inventive artificial nucleic acid comprised in a single dose is typically at least 5 µg, preferably from 10 µg to 500 µg, more preferably from 20 µg to 200 µg, even more preferably from 30 µg to 100 µg. In the case of intradermal injection, which is preferably carried out via jet injection (e.g. using a Tropis device), the amount of the inventive artificial nucleic acid comprised in a single dose is typically at least 10 µg, preferably from 20 µg to 200 µg, more preferably from 30 µg to 100 µg. Moreover, in the case of intramuscular injection, which is preferably carried out by using a conventional needle or via jet injection, the amount of the inventive artificial nucleic acid comprised in a single dose is typically at least 1 µg, preferably from 1 µg to 500 µg, more preferably from 5 µg to 500 µg, even more preferably from 10 µg to 200 µg.

The immunization protocol for the treatment or prophylaxis of a Henipvirus and/or a Nipah virus and/or a Hendra virus infection, i.e the immunization of a subject against Henipvirus and/or a Nipah virus and/or a Hendra virus, typically comprises a series of single doses or dosages of the inventive composition or the inventive vaccine. A single dosage, as used herein, refers to the initial/first dose, a second dose or any further doses, respectively, which are preferably administered in order to "boost" the immune reaction.

According to a preferred embodiment, the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts is provided for use in treatment or prophylaxis, preferably treatment or prophylaxis of a Henipvirus and/or a Nipah virus and/or a Hendra virus infection or a related disorder or disease, wherein the treatment or prophylaxis comprises the administration of a further active pharmaceutical ingredient. More preferably, in the case of the inventive vaccine or composition, which is based on the inventive artificial nucleic acid, a polypeptide may be co-administered as a further active pharmaceutical ingredient. For example, at least one Henipvirus and/or a Nipah virus and/or a Hendra virus protein or peptide as described herein, or a fragment or variant thereof, may be co-administered in order to induce or enhance an immune response. Likewise, in the case of the inventive vaccine or composition, which is based on the inventive polypeptide as described herein, an artificial nucleic acid as described herein may be co-administered as a further active pharmaceutical ingredient. For example, an artificial nucleic acid as described herein encoding at least one polypeptide as described herein may be co-administered in order to induce or enhance an immune response.

A further component of the inventive vaccine or composition may be an immunotherapeutic agent that can be selected from immunoglobulins, preferably IgGs, monoclonal or polyclonal antibodies, polyclonal serum or sera, etc., most preferably immunoglobulins directed against a Henipvirus and/or a Nipah virus and/or a Hendra virus. Preferably, such a further immunotherapeutic agent may be provided as a peptide/protein or may be encoded by a nucleic acid, preferably by a DNA or an RNA, more preferably an mRNA. Such an immunotherapeutic agent allows providing passive vaccination additional to active vaccination triggered by the inventive artificial nucleic acid or by the inventive polypeptide.

In a further aspect the invention provides a method of treating or preventing a disorder, wherein the disorder is preferably an infection with Henipvirus and/or a Nipah virus and/or a Hendra virus or a disorder related to an infection with Henipvirus and/or a Nipah virus and/or a Hendra virus, wherein the method comprises administering to a subject in need thereof the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts.

In particular, such a method may preferably comprise the steps of:
a) providing the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts;
b) applying or administering the artificial nucleic acid according to the invention, the inventive composition comprising at least one artificial nucleic acid according to the invention, the inventive polypeptides as described herein, the inventive composition comprising at least one inventive polypeptide, the inventive vaccine or the inventive kit or kit of parts to a tissue or an organism;
c) optionally administering immunoglobuline (IgGs) against Henipvirus and/or a Nipah virus and/or a Hendra virus.

According to a further aspect, the present invention also provides a method for expression of at least one polypeptide comprising at least one Henipvirus and/or a Nipah virus and/or a Hendra virus, or a fragment or variant thereof, wherein the method preferably comprises the following steps:
a) providing the inventive artificial nucleic acid comprising at least one coding region encoding at least one polypeptide comprising at least one Henipvirus and/or a Nipah virus and/or a Hendra virus, or a fragment or variant thereof, preferably as defined herein, or a composition comprising said artificial nucleic acid; and
b) applying or administering the inventive artificial nucleic acid or the inventive composition comprising said artificial nucleic acid to an expression system, e.g. to a cell-free expression system, a cell (e.g. an expression host cell or a somatic cell), a tissue or an organism.

The method may be applied for laboratory, for research, for diagnostic, for commercial production of peptides or proteins and/or for therapeutic purposes. In this context, typically after preparing the inventive artificial nucleic acid as defined herein or of the inventive composition or vaccine as defined herein, it is typically applied or administered to a cell-free expression system, a cell (e.g. an expression host cell or a somatic cell), a tissue or an organism, e.g. in naked or complexed form or as a (pharmaceutical) composition or vaccine as described herein, preferably via transfection or by using any of the administration modes as described herein. The method may be carried out in vitro, in vivo or ex vivo. The method may furthermore be carried out in the context of the treatment of a specific disease, particularly in the treatment of infectious diseases, preferably Henipvirus and/or a Nipah virus and/or a Hendra virus infection or a related disorder as defined herein.

In this context, in vitro is defined herein as transfection or transduction of the inventive artificial nucleic acid as defined herein or of the inventive composition or vaccine as defined herein into cells in culture outside of an organism; in vivo is defined herein as transfection or transduction of the inventive artificial nucleic acid or of the inventive composition or vaccine into cells by application of the inventive mRNA or of the inventive composition to the whole organism or individual and ex vivo is defined herein as transfection or transduction of the inventive artificial nucleic acid or of the inventive composition or vaccine into cells outside of an organism or individual and subsequent application of the transfected cells to the organism or individual.

Likewise, according to another aspect, the present invention also provides the use of the inventive artificial nucleic acid as defined herein or of the inventive composition or vaccine as defined herein, preferably for diagnostic or therapeutic purposes, for expression of an encoded Henipvirus and/or a Nipah virus and/or a Hendra virus antigenic peptide or protein, e.g. by applying or administering the inventive artificial nucleic acid as defined herein or of the inventive composition or vaccine as defined herein, e.g. to a cell-free expression system, a cell (e.g. an expression host cell or a somatic cell), a tissue or an organism. The use may be applied for a (diagnostic) laboratory, for research, for diagnostics, for commercial production of peptides or proteins and/or for therapeutic purposes. In this context, typically after preparing the inventive artificial nucleic acid as defined herein or of the inventive composition or vaccine as defined herein, it is typically applied or administered to a cell-free expression system, a cell (e.g. an expression host cell or a somatic cell), a tissue or an organism, preferably in naked form or complexed form, or as a (pharmaceutical) composition or vaccine as described herein, preferably via transfection or by using any of the administration modes as described herein. The use may be carried out in vitro, in vivo or ex vivo. The use may furthermore be carried out in the context of the treatment of a specific disease, particularly in the treatment of NIPAH virus infection or a related disorder.

In a particularly preferred embodiment, the invention provides the artificial nucleic acid, the inventive composition or the inventive vaccine for use as defined herein, preferably for use as a medicament, for use in treatment or prophylaxis, preferably treatment or prophylaxis of a Henipvirus and/or a Nipah virus and/or a Hendra virus infection or a related disorder, or for use as a vaccine.

EXAMPLES

Figure 1:
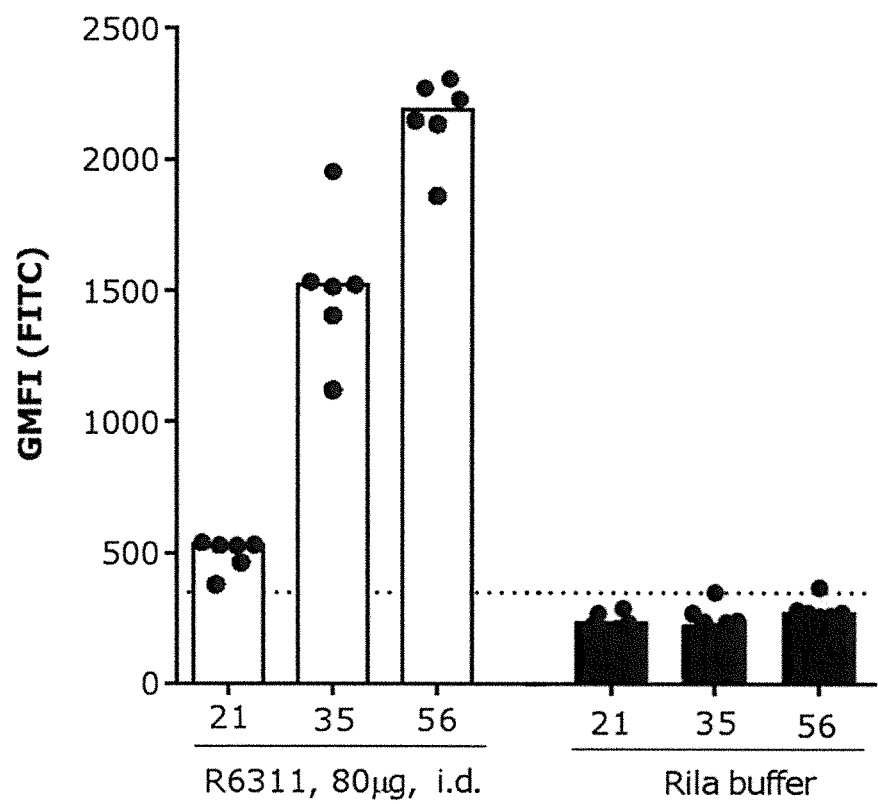
FIG. 1: shows that mRNA encoding Nipah virus F protein (R6311) induces specific humoral immune responses after immunization in mice. Further details are provided in Example 2.

The Examples shown in the following are merely illustrative and shall describe the present invention in a further way. These Examples shall not be construed to limit the present invention thereto.

Example 1: Preparation of mRNA Constructs for In Vitro and In Vivo Experiments

For the present examples, DNA sequences encoding Nipah virus proteins as well as DNA sequences encoding Hendra virus proteins are prepared and used for subsequent RNA in vitro transcription reactions. The generated coding sequences (RNA sequences) are provided in the sequence listing (SEQ ID NOs: 27-234, 599-806, 833-1040, 1067-1274, 1275-1508). DNA sequences are prepared by modifying the wild type encoding DNA sequences by introducing a GC-optimized sequence for stabilization, using an in silico algorithms that increase the GC content of the respective coding sequence. Moreover, sequences are introduced into a pUC19 derived vector and modified to comprise stabilizing sequences derived from alpha-globin-3'-UTR, a stretch of 30 cytosines, a histone-stem-loop structure, and a stretch of 64 adenosines at the 3'-terminal end (poly-A-tail) (indicated as "mRNA design 1" in Table 5, Table 6, Table 7). Other sequences were introduced into a pUC19 derived vector to comprise stabilizing sequences derived from 32L4 5'-UTR, ribosomal 5'TOP UTR and 3'-UTR derived from albumin 7, a stretch of 30 cytosines, a histone-stem-loop structure, and a stretch of 64 adenosines at the 3'-terminal end (poly-A-tail) (indicated as "mRNA design 2" in Table 5, Table 6, Table 7). The obtained plasmid DNA constructs are transformed and propagated in bacteria (*Escherichia coli*) using common protocols known in the art.

RNA In Vitro Transcription on Linearized pDNA:

The DNA plasmids prepared according to paragraph 1 are enzymatically linearized using EcoRI and transcribed in vitro using DNA dependent T7 RNA polymerase in the presence of a nucleotide mixture and cap analog (m7GpppG) under suitable buffer conditions. RNA production is performed under current good manufacturing practice according to WO2016180430. The obtained mRNAs are purified using PureMessenger® (CureVac, Tubingen, Germany; WO2008077592) and used for in vitro and in vivo experiments.

RNA In Vitro Transcription on PCR Amplified DNA Templates:

DNA plasmids prepared according to paragraph 1, or synthic DNA constructs are used for PCR-amplification. The generated PCR templates are used for subsequent RNA in vitro transcription using DNA dependent T7 RNA polymerase in the presence of a nucleotide mixture and cap analog (m7GpppG) under suitable buffer conditions. The obtained mRNA constructs are purified using PureMessenger® (CureVac, Tubingen, Germany; WO2008077592) and used for in vitro and in vivo experiments. The generated mRNA constructs are indicated as "mRNA design 3" Table 5 and Table 6.

TABLE 7 mRNA constructs used in the Example section:

| Name | SEQ ID NO: Protein | mRNA |
|---|---|---|
| NIPAV(Malaysia) | 1 | SEQ ID NO: 1353 mRNA design 2; opt1 |
| NIPAV(Malaysia) | 12 | SEQ ID NO: 1364 mRNA design 2; opt1 |
| NIPAV(Bangladesh2004) | 3 | SEQ ID NO: 1355 mRNA design 2; opt1 |
| NIPAV(Bangladesh2004) | 13 | SEQ ID NO: 1365 mRNA design 2; opt1 |
| HeV(Horse-Autralia-Hendra-1994)-F | 8 | SEQ ID NO: 1360 mRNA design 2; opt1 |
| HeV(Horse-Autralia-Hendra-1994)-G | 19 | SEQ ID NO: 1371 mRNA design 2; opt1 |
| IgE-leader(GC)__HeV(Horse-Autralia-Hendra-1994)-G(71-604) | 825 | SEQ ID NO: 1397 mRNA design 2; opt1 |
| IgE-leader__Nipha(Bangladesh2004)-F | 809 | SEQ ID NO: 1381 mRNA design 2; opt1 |
| SP-Influenza-HA__Nipha(Bangladesh2004)-F | 1043 | SEQ ID NO: 1407 mRNA design 2; opt1 |
| SP-Osteonectin BM40__Nipha(Bangladesh2004)-F | 1513 | SEQ ID NO: 1543 mRNA design 2; opt1 |
| SP-HsChemo-tripsinogen__Nipha(Bangladesh2004) | 1514 | SEQ ID NO: 1544 mRNA design 2; opt1 |
| SP-Nipha(Malaysia1999)-F(1-26)__Nipha(Bangladesh2004)-F(27-546) | 1515 | SEQ ID NO: 1545 mRNA design 2; opt1 |

Example 2: Vaccination of Mice with mRNA Encoding Nipah

The results of the present Example shows that mRNA encoding Nipah virus F protein (NIV F Malaysia 1999; R6311) is expressed in mice after intradermal injection. In addition, the expressed Nipah virus F protein provided by the inventive mRNA of the invention induces specific humoral immune responses after immunization in mice.

Preparation of Protamine Complexed mRNA ("Vaccine Composition 1")

Nipah virus mRNA construct (SEQ ID NO: 1353) was prepared as described in Example 1 (RNA in vitro transcription). HPLC purified mRNA was complexed with protamine prior to use in in vivo vaccination experiments. The mRNA complexation consisted of a mixture of 50% free mRNA and 50% mRNA complexed with protamine at a weight ratio of 2:1. First, mRNA was complexed with protamine by addition of protamine-Ringer's lactate solution to mRNA. After incubation for 10 minutes, when the complexes were stably generated, free mRNA was added, and the final concentration of the vaccine was adjusted with Ringer's lactate solution.

Immunization:

Female BALB/c mice were injected intradermally (i.d.) with mRNA vaccine compositions with doses, application routes and vaccination schedules as indicated in Table A. As a negative control, one group of mice was vaccinated with buffer (ringer lactate). All animals were vaccinated on day 0, 21 and 42. Blood samples were collected on day 21, 35, and 56 for the determination of antibody titers.

TABLE A

| Vaccination regimen (Example 2): | | | |
| --- | --- | --- | --- |
| Number of mice | Vaccine composition | Dose | Route/Volume |
| 10 | NIV F (Malaysia 1999) R6311; Vaccine composition 1 | 80 µg | i.d. 2 × 50 µl |
| 10 | 100% RiLa Control | | i.d. 2 × 25 µl |

Detection of Specific Humoral Immune Responses:

Hela cells were transfected with 2 µg of either R6311 vaccine composition using lipofectamine. The cells were harvested 20 h post transfection, and seeded at 1×10$^5$ per well into an 96 well plate. The cells were incubated with sera of R6311 vaccinated mice (diluted 1:50) followed by aFITC-conjugated anti-mouse IgG antibody. Cells were acquired on BD FACS Canto II using DIVA software and analyzed by FlowJo.

Results:

As shown in FIG. 1, the mRNA encoding Nipah virus F protein (NIV F Malaysia 1999; R6311) is expressed in mice after i.d. administration. Moreover, as specific anti-NIV F IgGs were detected in sera of immunized mice, the results also show that the applied mRNA vaccine is suitable to induce specific humoral immune responses.

The results exemplify that the inventive mRNA-based Nipah virus vaccine works and that similar mRNA vaccines comprising alternative mRNA constructs according to the invention may also be suitably used.

Example 3: Expression Analysis of Nipah Virus and Hendra Virus G Proteins Using Western Blot The results of the present Example shows that mRNA encoding Nipah virus G protein and Hendra virus G protein are expressed in HeLa cells after transfection.

Figure 2:
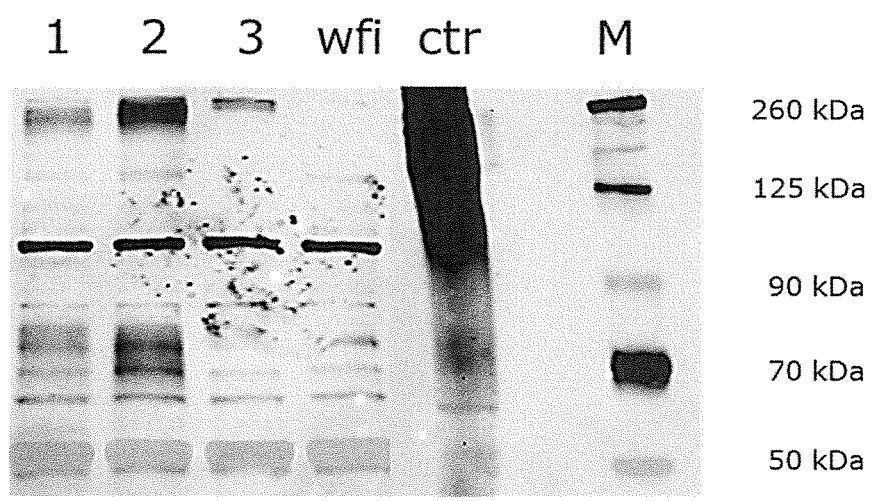
FIG. 2: shows that mRNA encoding Henipavirus G protein is expressed in cells after transfection. Further details are provided in Example 3.

For the analysis of Nipah virus protein and Hendra virus G protein expression, HeLa cells were transfected with 2 µg unformulated mRNA (wfi as negative control) using Lipofectamine as the transfection agent 20 hours post transfection, HeLa cells were detached by trypsin-free/EDTA buffer, harvested, and cell lysates were prepared. Cell lysates were subjected to SDS-PAGE followed by western blot detection. Western Blot analysis was performed using an anti-NIV G protein polyclonal IgG serum fraction (custom made by through immunization of rabbits with peptides from NIV G (with x-reactivity to HeV G protein)) used in a 1:200 dilution in combination with secondary anti rabbit antibody coupled to IRDye 800CW (Licor Biosciences). The presence of αβ-tubulin was analyzed (αβ-tubulin; Cell Signalling Technology; 1:1000 diluted) in combination with secondary anti rabbit antibody coupled to IRDye 680RD (Licor Biosciences). Inactivated Nipah virus was used as positive control for the western blot (indicated as "ctr" in FIG. 2). The outline of the experiment is shown in Table B. The result of the experiment is shown in FIG. 2.

TABLE B

| Expression analysis experiment (Example 2): | | |
| --- | --- | --- |
| Lane | SEQ ID NO | Transfected composition |
| 1 | 1364 | Nipah virus G (Malaysia) R6003 |
| 2 | 1365 | Nipah virus G (Bangladesh) R6007 |
| 3 | 1371 | Hendra virus G R6011 |
| 4 | — | wfi |

Results:

As shown in FIG. 2, the mRNA encoding Henipavirus G protein is expressed in HeLa cells as the immunostaining for cell lysates of mRNA transfected cells was substantially increased compared to the wfi control group. In particular, immunostaining at about 70 kDa (G monomer) and about 260 kDa (G multimer) were detected. The results exemplify that the inventive mRNA encoding Henipavirus G protein is translated in cells and that alternative mRNA constructs according to the invention may also be translated in cells, which is a prerequisite for an mRNA-based vaccine.

Example 4: Expression of Nipah Virus and Hendra Virus Proteins in HeLa Cells and Analysis by FACS To determine in vitro protein expression of the constructs, HeLa cells are transiently transfected with mRNA encoding Nipah virus (NiV) and Hendra virus (HeV) antigens and stained using suitable customized anti-NiV antibodies (raised in mouse) and anti-HeV antibodies, counterstained with a FITC-coupled secondary antibody (F5262 from Sigma). HeLa cells are seeded in a 6-well plate at a density of 400,000 cells/well in cell culture medium (RPMI, 10% FCS, 1% L-Glutamine, 1% Pen/Strep), 24 h prior to transfection. HeLa cells are transfected with 1 and 2 µg unformulated mRNA using Lipofectamine 2000 (Invitrogen). The mRNA constructs according to Example 1 are used in the experiment, including a negative control encoding an irrelevant protein. 24 hours post transfection, HeLa cells are stained with suitable anti anti-NiV or anti-HeV antibodies (raised in mouse; 1:500) and anti-mouse FITC labelled secondary antibody (1:500) and subsequently analyzed by flow cytometry (FACS) on a BD FACS Canto II using the FACS Diva software. Quantitative analysis of the fluorescent FITC signal is performed using the FlowJo software package (Tree Star, Inc.).

Example 5: Analysis of Expression and Secretion of Nipah Virus and Hendra Virus Proteins Using Western Blot For the analysis of Nipah virus protein and Hendra virus protein secretion, HeLa cells are transfected with 1 µg and 2 µg unformulated mRNA (including a negative control encoding an irrelevant protein) using Lipofectamine as the transfection agent. Supernatants, harvested 24 hours post transfection, are filtered through a 0.2 µm filter. Clarified supernatants are applied on top of 1 ml 20% sucrose cushion (in PBS) and centrifuged at 14000 rcf (relative centrifugal force) for 2 hours at 4° C. Protein content is analyzed by Western Blot using anti-NiV and anti-HeV antibodies as primary antibody in combination with secondary anti mouse antibody coupled to IRDye 800CW (Licor Biosciences). The presence of αβ-tubulin is also analyzed as control for cellular contamination (αβ-tubulin; Cell Signalling Technology; 1:1000 diluted) in combination with secondary anti rabbit antibody coupled to IRDye 680RD (Licor Biosciences). For the analysis of NiV and HeV proteins in cell lysates, HeLa cells are transfected with 1 µg and 2 µg unformulated mRNAs (generated according to Example 1) including a negative control encoding an irrelevant protein using Lipofectamine as the transfection agent 24 hours post transfection, HeLa cells are detached by trypsin-free/EDTA buffer, harvested, and cell lysates are prepared. Cell lysates are subjected to SDS-PAGE under non-denaturating/non-reducing followed by western blot detection. Western Blot analysis is performed using a anti NiV and anti-HeV antibodies as primary antibody in combination with secondary anti mouse antibody coupled to IRDye 800CW (Licor Biosciences).

Example 6: Preparation of Nipah Virus and Hendra Virus Vaccine Compositions

For further in vivo vaccination experiments, different compositions of Nipah virus mRNA vaccine and Hendra virus mRNA vaccine are prepared using constructs obtained in Example 1. One composition comprises protamine-complexed mRNA, one composition comprises mRNA that is formulated without protamine ("naked"), one composition comprises mRNA that is encapsulated in lipid nanoparticles (LNPs), and one composition comprises polymer-lipidoid complexed mRNA.

Nipah virus and Hendra virus mRNA constructs are complexed as described in Example 2.

Nipah virus and Hendra virus mRNA constructs are formulated without protamine. The final concentration of the vaccine is adjusted with Ringers lactate solution.

Preparation of LNP Encapsulated mRNA ("Vaccine Composition 3")

A lipid nanoparticle (LNP)-encapsulated mRNA mixture is prepared using an ionizable amino lipid (cationic lipid), phospholipid, cholesterol and a PEGylated lipid. LNPs are prepared as follows. Cationic lipid, DSPC, cholesterol and PEG-lipid are solubilized in ethanol. Briefly, mRNA mixture is diluted to a total concentration of 0.05 mg/mL in 50 mM citrate buffer, pH 4. Syringe pumps are used to mix the ethanolic lipid solution with the mRNA mixture at a ratio of about 1:6 to 1:2 (vol/vol). The ethanol is then removed and the external buffer replaced with PBS by dialysis. Finally, the lipid nanoparticles are filtered through a 0.2 µm pore sterile filter. Lipid nanoparticle particle diameter size is determined by quasi-elastic light scattering using a Malvern Zetasizer Nano (Malvern, UK).

Preparation of Polymer-Lipidoid Complexed mRNA ("Vaccine Composition 4")

20 mg peptide (CHHHHHHRRRRHHHHHHC—NH2; SEQ ID NO: 309) TFA salt is dissolved in 2 mL borate buffer pH 8.5 and stirred at room temperature for approximately 18 h. Then, 12.6 mg PEG-SH 5000 (Sunbright) dissolved in N-methylpyrrolidone is added to the peptide solution and filled up to 3 mL with borate buffer pH 8.5. After 18 h incubation at room temperature, the reaction mixture is purified and concentrated by centricon procedure (MWCO 10 kDa), washed against water, and lyophilized. The obtained lyophilisate is dissolved in ELGA water and the concentration of the polymer is adjusted to 10 mg/mL. The obtained polyethylene glycol/peptide polymers (HO-PEG 5000-S—(S—CHHHHHHRRRRHHHHHHC—S-)7-S-PEG 5000-OH-amino acid component: SEQ ID NO: 309) are used for further formulation and are hereinafter referred to as PB83.

Preparation of 3-C12-OH Lipidoid

First, lipidoid 3-C12 was obtained by acylation of tris(2-aminoethyl)amine with an activated lauric (C12) acid derivative, followed by reduction of the amide. Alternatively, it may be prepared by reductive amination with the corresponding aldehyde. Lipidoid 3-C12-OH was prepared by addition of the terminal C12 alkyl epoxide with the same oligoamine according to Love et al., pp. 1864-1869, PNAS, vol. 107 (2010), no. 5.

Preparation of Compositions with Nanoparticles of Polymer-Lipidoid Complexed mRNA First, ringer lactate buffer (RiLa; alternatively e.g. saline (NaCl) or PBS buffer may be used), respective amounts of lipidoid, and respective amounts of a polymer (PB83) are mixed to prepare compositions comprising a lipidoid and a peptide or polymer. Then, the carrier compositions are used to assemble nanoparticles with the mRNA by mixing the mRNA with respective amounts of polymer-lipidoid carrier and allowing an incubation period of 10 minutes at room temperature such as to enable the formation of a complex between the lipidoid, polymer and mRNA. In order to characterize the integrity of the obtained polymer-lipidoid complexed mRNA particles, RNA agarose gel shift assays are performed. In addition, size measurements are performed (gel shift assay, Zetasizer) to evaluate whether the obtained nanoparticles have a uniform size profile.

Example 7: Vaccination of Mice and Evaluation of Nipah Virus Specific Immune Response Female BALB/c mice are injected intradermally (i.d.) and intramuscularly (i.m.) with respective mRNA vaccine compositions (prepared according to Example 6) with doses, application routes and vaccination schedules as indicated in Table C. As a negative control, one group of mice is vaccinated with buffer (ringer lactate). All animals are vaccinated on day 1, 21 and 35. Blood samples are collected on day 21, 35, and 63 for the determination of binding and neutralizing antibody titers (see below).

TABLE C

Vaccination regimen - Nipah virus experiment (Example 7)

| Group | Number of mice | Vaccine composition | Route/ Volume | Vaccination Schedule (day) |
|---|---|---|---|---|
| 1 | 10 | 40 µg Nipah virus RNA Composition 1 | i.d. 2 × 25 µl | 0/21/35 |
| 2 | 10 | 40 µg Nipah virus RNA Composition 1 | i.m. 2 × 25 µl | 0/21/35 |
| 3 | 10 | 20 µg Nipah virus RNA Composition 2 | i.d. 2 × 25 µl | 0/21/35 |
| 4 | 10 | 20 µg Nipah virus RNA Composition 2 | i.m. 2 × 25 µl | 0/21/35 |
| 5 | 10 | 10 µg Nipah virus RNA Composition 3 | i.d. 2 × 25 µl | 0/21/35 |
| 6 | 10 | 10 µg Nipah virus RNA Composition 3 | i.m. 2 × 25 µl | 0/21/35 |
| 7 | 10 | 100% RiLa Control | i.d. 2 × 25 µl | 0/21/35 |

Determination of Anti Nipah Virus Protein Antibodies by ELISA:

ELISA is performed using inactivated Nipah virus infected cell lysate for coating. Coated plates are incubated using respective serum dilutions, and binding of specific antibodies to the Nipah virus antigens are detected using biotinylated isotype specific anti-mouse antibodies followed by streptavidin-HRP (horse radish peroxidase) with ABTS as substrate. Endpoint titers of antibodies directed against the Nipah virus antigens are measured by ELISA on day 63 after three vaccinations.

Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates ($2 \times 10^6$ cells per well). The cells are stimulated with a mixture of four Nipah virus protein specific peptide epitopes (5 µg/ml of each peptide) in the presence of 2.5 µg/ml of an anti-CD28 antibody (BD Biosciences) for 6 hours at 37° C. in the presence of a protein transport inhibitor. After stimulation, cells are washed and stained for intracellular cytokines using the Cytofix/Cytoperm reagent (BD Biosciences) according to the manufacturer's instructions. The following antibodies are used for staining: CD3-FITC (1:100), CD8-PE-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

Nipah Virus Plaque Reduction Neutralization Test (PRNT50):

Sera are analyzed by a plaque reduction neutralization test (PRNT50), performed as commonly known in the art. Briefly, obtained serum samples of vaccinated mice are incubated with Nipah virus. That mixture is used to infect cultured cells, and the reduction in the number of plaques is determined.

Example 8: Vaccination of Mice and Evaluation of Hendra Virus Specific Immune Response Female BALB/c mice are injected intradermally (i.d.) and intramuscularly (i.m.) with respective mRNA vaccine compositions (prepared according to Example 6) with doses, application routes and vaccination schedules as indicated in Table D. As a negative control, one group of mice is vaccinated with buffer (ringer lactate). All animals are vaccinated on day 1, 21 and 35. Blood samples are collected on day 21, 35, and 63 for the determination of binding and neutralizing antibody titers (see below).

Determination of Anti Hendra Virus Protein Antibodies by ELISA:

ELISA is performed using inactivated Hendra virus infected cell lysate for coating. Coated plates are incubated using respective serum dilutions, and binding of specific antibodies to the Hendra virus antigens are detected using biotinylated isotype specific anti-mouse antibodies followed by streptavidin-HRP (horse radish peroxidase) with ABTS as substrate. Endpoint titers of antibodies directed against the Hendra virus antigens are measured by ELISA on day 63 after three vaccinations.

TABLE D

Vaccination regimen - Hendra virus experiment (Example 8):

| Group | Number of mice | Vaccine composition | Route/ Volume | Vaccination Schedule (day) |
|---|---|---|---|---|
| 1 | 10 | 40 µg Hendra virus RNA Composition 1 | i.d. 2 × 25 µl | 0/21/35 |
| 2 | 10 | 40 µg Hendra virus RNA Composition 1 | i.m. 2 × 25 µl | 0/21/35 |
| 3 | 10 | 20 µg Hendra virus RNA Composition 2 | i.d. 2 × 25 µl | 0/21/35 |
| 4 | 10 | 20 µg Hendra virus RNA Composition 2 | i.m. 2 × 25 µl | 0/21/35 |
| 5 | 10 | 10 µg Hendra virus RNA Composition 3 | i.d. 2 × 25 µl | 0/21/35 |
| 6 | 10 | 10 µg Hendra virus RNA Composition 3 | i.m. 2 × 25 µl | 0/21/35 |
| 7 | 10 | 100% RiLa Control | i.d. 2 × 25 µl | 0/21/35 |

Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates ($2 \times 10^6$ cells per well). The cells are stimulated with a mixture of four Hendra virus protein specific peptide epitopes (5 µg/ml of each peptide) in the presence of 2.5 µg/ml of an anti-CD28 antibody (BD Biosciences) for 6 hours at 37° C. in the presence of a protein transport inhibitor. After stimulation, cells are washed and stained for intracellular cytokines using the Cytofix/Cytoperm reagent (BD Biosciences) according to the manufacturer's instructions. The following antibodies are used for staining: CD3-FITC (1:100), CD8-PE-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

Nipah Virus Plaque Reduction Neutralization Test (PRNT50):

Sera are analyzed by a plaque reduction neutralization test (PRNT50), performed as commonly known in the art. Briefly, obtained serum samples of vaccinated mice are incubated with Hendra virus. That mixture is used to infect cultured cells, and the reduction in the number of plaques is determined.

Example 9: Vaccination of Mice Using Polymer-Lipidoid Complexed RNA and Evaluation of Immune Response Female BALB/c mice are injected intramuscularly (i.m.) with respective mRNA vaccine compositions (prepared according to Example 6) with doses, application routes and vaccination schedules as indicated in Table F. As a negative control, one group of mice is vaccinated with buffer (ringer lactate). All animals are vaccinated on day 1, 21 and 35. Blood samples are collected on day 21, 35, and 63 for the determination of binding and neutralizing antibody titers (see below).

Evaluation of Specific Immune Responses:

ELISA is performed using inactivated Hendra virus or Nipah virus infected cell lysate for coating (as described above). Splenocytes from vaccinated mice are isolated according to a standard protocol known in the art and intracellular cytokine staining is performed as described above. In addition, sera are analyzed by a plaque reduction neutralization test (PRNT50), performed as described above.

TABLE F

Vaccination regimen (Example 9):

| Group | Number of mice | Vaccine composition | Route/ Volume | Vaccination Schedule (day) |
|---|---|---|---|---|
| 1 | 10 | 40 µg Hendra virus RNA Composition 4 | i.m. 2 × 25 µl | 0/21/35 |
| 2 | 10 | 40 µg Nipah virus RNA Composition 4 | i.m. 2 × 25 µl | 0/21/35 |
| 3 | 10 | 100% RiLa Control | i.d. 2 × 25 µl | 0/21/35 |

Example 10: Clinical Development of a Nipah Virus and Hendra Virus mRNA Vaccine Composition To demonstrate safety and efficiency of the Nipah virus and Hendra virus mRNA vaccine composition, a clinical trial (phase I) is initiated. In the clinical trial, a cohort of human volunteers is intradermally or intramuscularly injected for at least two times. In order to assess the safety profile of the vaccine compositions according to the invention, subjects are monitored after administration (vital signs, vaccination site tolerability assessments, hematologic analysis). The efficacy of the immunization is analyzed by determination of virus neutralizing titers (VNT) in sera from vaccinated subjects. Blood samples are collected on day 0 as baseline and after completed vaccination. Sera are analyzed for virus neutralizing antibodies.

SEQUENCE LISTING (1548 sequences)

SEQ ID NO: 1 - protein, 546 aa, Artificial Sequence
  derived and/or modified protein sequence (wt) from Nipah henipavirus__AAK50553__F
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 2 - protein, 546 aa, Artificial Sequence
  derived and/or modified protein sequence (wt) from Nipah henipavirus__AEZ01388__F
MAVILNKRYYSNLLILILIISECSVGILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 3 - protein, 546 aa, Artificial Sequence
  derived and/or modified protein sequence (wt) from Nipah henipavirus__AAY43915__F
MAVILNKRYYSNLLILILMISECSVGILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYSSDLLFVFGPNLQDPVSNSMTIQAISQAFGGNYETLLRTLGYATEGFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 4 - protein, 546 aa, Artificial Sequence
  derived and/or modified protein sequence (wt) from Nipah henipavirus__CAF25496__F
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYAIEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 5 - protein, 546 aa, Artificial Sequence
  derived and/or modified protein sequence (wt) from Nipah henipavirus__AAM13405__F
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPTTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 6 - protein, 546 aa, Artificial Sequence
  derived and/or modified protein sequence (wt) from Nipah henipavirus__CBM41033__F
MVVILDKRCYSNLLILILMISECSVGILHYEKLSKIGLVKGVTRKYKIKSNPLTKDIVIKMIANVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQKSSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 7 - protein, 546 aa, Artificial Sequence
  derived and/or modified protein sequence (wt) from Nipah henipavirus__AEZ01396__F
MAVILNKRYYSNLLILILMISECSVGILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 8 - protein, 546 aa, Artificial Sequence
  derived and/or modified protein sequence (wt) from Hendra henipavirus__NP_047111__F
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 9 - protein, 546 aa, Artificial Sequence
  derived and/or modified protein sequence (wt) from Hendra henipavirus__AEB21233__F
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 10 - protein, 546 aa, Artificial Sequence
  derived and/or modified protein sequence (wt) from Hendra henipavirus__AEQ38114__F
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFIIVEKKRGNYSRLDDRQVRPVSNGDLYYIGT

SEQ ID NO: 11 - protein, 546 aa, Artificial Sequence
  derived and/or modified protein sequence (wt) from Hendra henipavirus__AAB39505__F
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLLICSCFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSREQTLLMIDNTTCTTVVLGNIIISLPKYLGSIKLQVLRALLLGHQSIQTKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 12 - protein, 602 aa, Artificial Sequence
  derived and/or modified protein sequence (wt) from Nipah henipavirus__AAK50554__G
MPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 13 - protein, 602 aa, Artificial Sequence
  derived and/or modified protein sequence (wt) from Nipah henipavirus__AEZ01389__G
MPTESKKVRFENTASDKGKNPSKVIKSYYGTMDIKKINEGLLDSKILSAFNTVIALLGSIVIIVMNIMIIQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPILNSTYWSGSLMMTRLAVKPKNNGESYNQHQFALRNIEKGKYDKVMPYGPSGIKQGDTLYFPAVGFLVRTEFKYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 14 - protein, 602 aa, Artificial Sequence
  derived and/or modified protein sequence (wt) from Nipah henipavirus__ACT32615__G
MPTESKKVRFENTASDKGKNPSKVIKSYYGTMDIKKINEGLLDSKILSAFNTVIALLGSIVIIVMNIMIIQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPVLNSTYWSGSLMMTRLAVKPKNNGESYNQHQFALRNIEKGKYDKVMPYGPSGIKQGDTLYFPAVGFLVRTEFKYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 15 - protein, 602 aa, Artificial Sequence
  derived and/or modified protein sequence (wt) from Nipah henipavirus__CAF25497__G
MPAENKKVRFENTTSDKGKNPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWAPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 16 - protein, 602 aa, Artificial Sequence
  derived and/or modified protein sequence (wt) from Nipah henipavirus__CBM41034__G
MPAENKKVRFENTTSDKGKNPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPDNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKIVFIEISDQRLSIGSPSKVYDSLGQPVFYQASFSWDTMIKFGDVQTVNPLVVNWRDNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 17 - protein, 602 aa, Artificial Sequence
  derived and/or modified protein sequence (wt) from Nipah henipavirus__AAX51853__G
MPAESKKVRFENTTSDKGKIPSKIIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQKIIGVGEVLDRGDEVPSLFMTNVWTPPNPNTVYHCSAVYNNEFYYVLCAVSTVGDPILNSTYWSGSLMMTRLAVKPKSNDGGYNQHQLALRSIEKGRYDKVMPYGPSGIKQGDTLYFPAVGFLVRTEFKYNDSNCPITKCQYSKPENCRLSMGIRPNSHYVLRSGLLKYNLSDGENPKIVFIEISDQRLSIGSPSKIYDSLGQPVFYQASFSWDTMIKFGDVQTVNPLVVSWRDNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 18 - protein, 602 aa, Artificial Sequence
  derived and/or modified protein sequence (wt) from Nipah henipavirus__AEZ01397__G
MPTESKKVRFENTASDKGKNPSKVIKSYYGTMDIKKINEGLLDSKILSAFNTVIALLGSIVIIVMNIMIIQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPILNSTYWSGSLMMTRLAVKPKNNGESYNQHQFALRNIEKGKYDKVMPYGPSGIKQGDTLYFPAVGFLVRTEFTYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 19 - protein, 604 aa, Artificial Sequence
  derived and/or modified protein sequence (wt) from Hendra henipavirus__NP_047112__G
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 20 - protein, 604 aa, Artificial Sequence
  derived and/or modified protein sequence (wt) from Hendra henipavirus__AEB21225__G
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDITLQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 21 - protein, 604 aa, Artificial Sequence
  derived and/or modified protein sequence (wt) from Hendra henipavirus__AEB21216__G
MMADSKLVSPNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAINKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 22 - protein, 604 aa, Artificial Sequence
  derived and/or modified protein sequence (wt) from Hendra henipavirus__AEB21206__G
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGNYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDIDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 23 - protein, 604 aa, Artificial Sequence
  derived and/or modified protein sequence (wt) from Hendra henipavirus__AEQ38052__G
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYITITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 24 - protein, 604 aa, Artificial Sequence
  derived and/or modified protein sequence (wt) from Hendra henipavirus__AEQ38115__G
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDNGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 25 - protein, 604 aa, Artificial Sequence
  derived and/or modified protein sequence (wt) from Hendra henipavirus__AEQ38108__G
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYITITKVERGKYDKVMPYGPSGIKQGNTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 26 - protein, 604 aa, Artificial Sequence
  derived and/or modified protein sequence (wt) from Hendra henipavirus__AAV80426__G
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQCTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGSYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 27 - RNA, 1641 nt, Artificial Sequence
  derived and/or modified CDS sequence (wt) from Nipah henipavirus__AAK50553__F
augguaguuauacuugacaagagauguuauuguaaucuuuuaauauugauuuugaugaucucggaguguaguguugggauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuuaguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuaugaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 28 - RNA, 1641 nt, Artificial Sequence
  derived and/or modified CDS sequence (wt) from Nipah henipavirus__AEZ01388__F
auggcagucauacuuaacaagagauauuauucuaaucucuuaauacugauuuugauaaucucggagugcagugucgggauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacuaacugcuuugcaggauuacauuaauacuaacuugguaccgacaauugacaagauaagcugcaaacagacggaacucucauuagaucuagcacuaucaaaguaccucucugauuugcuuuuuguauuuggucccaaccuucaagacccaguuucuaauucaaugacuauacaggcuauaucucaggcauucgguggaaauuaugaaacacugcuaagaacguuggguuacgcuacagaagacuuugaugaucuucuagaaagugacagcauaacgggucaaauuaucuacguugauuuaaguggcuacuacauaauugucaggguuuauuuuccuauccugacugaaauccaacaggccuauauccaagaauuguugcccgugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcugaugauugauaacaccaccuguccuacagcuguacucgguaaugugaucaucagcuugggaaaauaucuugggucaguaaauuauaacucugaaggcauugcuauugguccuccugucuuuacugauaaaguugacauaucaagucaaauaucuagcaugaaucaguccuuacagcaaucuaaggacuauaucaaagaagcucaacgacuccuugauacuguuaacccgucauuaauaagcauguuaucuaugaucauacuguauguacuaucaauugcaucauuguguauaggguugauuacauuuaucaguuuuaucauuguugagaaaaaaagaaauaccuauagcagauuagaggacaggagggucagaccuacaagcaguggggaucucuauuacauugggacguag

SEQ ID NO: 29 - RNA, 1641 nt, Artificial Sequence
  derived and/or modified CDS sequence (wt) from Nipah henipavirus__AAY43915__F
auggcaguuauacuuaacaagagauauuauucuaaucucuuaauacugauuuugaugaucucggagugcagugucgggauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguacuccucugauuugcuuuuuguauuuggucccaaccuucaagacccaguuucuaauucaaugacuauacaggcuauaucucaggcauucgguggaaauuaugaaacacugcuaagaacguuggguuacgcuacagaaggcuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcuaaugauugauaacaccaccuguccuacagcuguacucgguaaugugaucaucagcuuggggaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 30 - RNA, 1641 nt, Artificial Sequence
  derived and/or modified CDS sequence (wt) from Nipah henipavirus__CAF25496__F
augguaguuauacuugacaagagauguuauuguaaucuuuuaauauugauuuugaugaucucggaguguaguguugggauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcuuuacaggauuacauuaauacuaauuuaguaccgacaauugacaaaauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuauagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauuaguaaggaauacauuaauaucaaauauagagauuggauuuugccuaauuacaaagaggagcgugaucugcaaccaagauuaugccacaccuaugaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 31 - RNA, 1641 nt, Artificial Sequence
  derived and/or modified CDS sequence (wt) from Nipah henipavirus__AAM13405__F
augguaguuauacuugacaagagauguuauuguaaucuuuuaauauugauuuugaugaucucggaguguaguguugggauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuuaguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuacgaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 32 - RNA, 1641 nt, Artificial Sequence
  derived and/or modified CDS sequence (wt) from Nipah henipavirus__CBM41033__F
augguaguuauacuugacaagagauguuauucuaaucuuuuaauauugauuuugaugaucucggaguguaguguugggauucuacauuaugagaaauugaguaaaauuggacuugucaaaggaguaacaagaaaauacaagauuaaaagcaauccucucacaaaagacauuguuauaaaaaugauugcgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugccauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuugguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuaugaccaacaacaugagagaauguuugacgggaucgacugagaaguguccucgagagcugguuguuucaucacauguucccagauuugcacuaucuaacggaguucuguuugccaauugcauaaguguuacaugccagugucaaacaacaggcagggcaaucucacagucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagaaauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuggaggauaggagagucagaccuacaagcaguggggaucucuacuacauugggacauag

SEQ ID NO: 33 - RNA, 1641 nt, Artificial Sequence
  derived and/or modified CDS sequence (wt) from Nipah henipavirus__AEZ01396__F
auggcaguuauacuuaacaagagauauuauucuaaucucuuaauacugauuuugaugaucucggagugcagugucgggauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaacuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguaccucucugauuugcuuuuuguauuuggucccaaccuucaagacccaguuucuaauucaaugacuauacaggcuauaucucaggcauucgguggaaauuaugaaacacugcuaagaacguuggguuacgcuacagaagacuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcuggugguuucaucacacguucccagauuugcacuaucuaacgggguuuuguuugcuaauugcauaagcgucacaugccagugucaaacaacagguagggcaaucucacagucaggagaacaaacucugcugaugauugauaacaccaccuguccuacagccguacucgguaaugugaucaucagcuugggaaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 34 - RNA, 1641 nt, Artificial Sequence
  derived and/or modified CDS sequence (wt) from Hendra henipavirus__NP_047111__F
auggcuacacaagaggucaggcuaaaguguuugcucugugggaucauaguucugguuuugucauuagaagggcuagggauacuacauuaugagaaacuuaguaagauagggcugguuaaagguauuacaagaaaguacaagauuaagaguaacccuuugaccaaggauauugugaucaaaaugaucccuaaugucucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcagguguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagagcucgcauuagacuuggcguugucuaaguaucugucugaucugcucuuuguuuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauagcaggccagauagucuauguagaucucaguagcuauuacauaauaguaaggguguauuuucccauacuaacagagauccaacaggcuuaugugcaggaguugcuuccagugaguuuuaauaacgauaauucagaauggaucagcauugucccgaauuucgugcugauuaggaacacgcugauuucaaauauagaagucaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcagcacugugcauuggucugaucacuuucauaagcuuuguaauaguugagaaaaagagagggaauuacagcaggcuagaugauaggcaagugcgaccggucaguaauggugaucuguauuauauuggaacauaa

SEQ ID NO: 35 - RNA, 1641 nt, Artificial Sequence
  derived and/or modified CDS sequence (wt) from Hendra henipavirus__AEB21233__F
auggcuacacaagaggucaggcuaaaguguuugcucugugggaucauaguucugguuuugucauuagaagggcuagggauacuacauuaugagaaacuuaguaagauagggcugguuaaagguauuacaagaaaguacaagauuaagaguaacccuuugaccaaggauauuguaaucaaaaugaucccuaauguuucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcaggcguggugauggcagggauugcaaucgggauagcuacugcugcacaaaucacagcagguguugcguuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagaacucgcauuagacuuggcguugucuaaguaucugucugaucugcucuuuguuuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuuccuauacuaacagagauccaacaggcuuaugugcaggaguugcuuccagugaguuuuaauaacgauaauucagaauggaucagcauugucccgaauuucgugcugauuaggaacacgcugauuucaaauauagaaguuaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauucgcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcggcacugugcauuggucugaucacuuucauaagcuuuguaauaguugagaaaaagagagggaauuacagcaggcuagaugauaggcaggugcgaccggucaguaauggugaucuguauuauauuggaacauaa

SEQ ID NO: 36 - RNA, 1641 nt, Artificial Sequence
  derived and/or modified CDS sequence (wt) from Hendra henipavirus__AEQ38114__F
auggcuacacaagaggucaggcuaaaguguuugcucugugggaucauaguucugguuuugucauuagaagggcuagggauacuacauuaugagaaacuuaguaagauagggcugguuaaagguauuacaagaaaguacaagauuaagaguaacccuuugaccaaggauauuguaaucaaaaugaucccuaauguuucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcaggcguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagaacucgcauuagacuuggcguugucuaaguaucugucugaucugcucuuuguuuucggacccaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuuccuauacuaacagagauccaacaggcuuaugugcaggaguugcuuccagugaguuuuaauaacgauaauucagaauggaucagcauugucccgaauuucgugcugauuaggaacacgcugauuucaaauauagaaguuaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcggcacugugcauuggucugaucacuuucauaagcuuuauaauaguugagaaaaagagagggaauuacagcaggcuagaugauaggcaggugcgaccggucaguaauggugaucuguauuauauuggaacauaa

SEQ ID NO: 37 - RNA, 1641 nt, Artificial Sequence
  derived and/or modified CDS sequence (wt) from Hendra henipavirus__AAB39505__F
auggcuacacaagaggucaggcuaaaguguuugcucugugggaucauaguucugguuuugucauuagaagggcuagggauacuacauuaugagaaacuuaguaagauagggcugguuaaagguauuacaagaaaguacaagauuaagaguaacccuuugaccaaggauauugugaucaaaaugaucccuaaugucucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcagguguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagagcucgcauuagacuuggcguugucuaaguaucugcugaucugcucuuguuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuucccauacuaacagagauccaacaggcuuaugugcaggaguugcuuccagugaguuuuaauaacgauaauucagaauggaucagcauugucccgaauuucgugcugauuaggaacacgcugauuucaaauauagaagucaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaauccagggaacagacacuacugaugauugacaauacuaccugcacaacaguuguucuaggaaacauaaucauaagccuuccaaaauauuugggaucaauaaaguuacaaguucugagagcauugcuguugggccaccagucuauacagacaaagguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcagcacugugcauuggucugaucacuuucauaagcuuuguaauaguugagaaaaagagagggaauuacagcaggcuagaugauaggcaagugcgaccggucaguaauggugaucuguauuauauuggaacauaa

SEQ ID NO: 38 - RNA, 1809 nt, Artificial Sequence
  derived and/or modified CDS sequence (wt) from Nipah henipavirus__AAK50554__G
augccggcagaaaacaagaaaguuagauucgaaaauacuacuucagacaaagggaaaauuccuaguaaaguuauuaagagcuacuacggaaccauggacauuaagaaaauaaaugaaggauuauuggacagcaaaauauuaagugcuuucaacacaguaauagcauugcuuggaucuaucgugaucauagugaugaauauaaugaucauccaaaauuacacaagaucaacagacaaucaggccgugaucaaagaugcguugcaggguauccaacagcagaucaaagggcuugcugacaaaaucggcacagagauagggcccaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacucccuuuuagagaguauaggccacagacagaaggggugagcaaucuaguaggauuaccuaauaauauuugccugcaaaagacaucuaaucagauauugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucuggaccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaguuguauucauugaaauaucugaucaaagauuaucuauuggaucuccuagcaaaaucuaugauucuuugggucaaccuguuuucuaccaagcgucauuuucaugggauacuaugauuaaauuuggagauguucuaacagucaacccucugguugucaauuggcguaauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuuuacuguauucaaagauaaugaaauacuuuauagggcacaacuggcuucugaggacaccaaugcacaaaaaacaauaacuaauuguuuucucuugaagaauaagauuuggugcauaucauugguugagauauaugacacaggagacaaugucauaagacccaaacuauucgcgguuaagauaccagagcaauguacauaa

SEQ ID NO: 39 - RNA, 1809 nt, Artificial Sequence
  derived and/or modified CDS sequence (wt) from Nipah henipavirus__AEZ01389__G
augccgacagaaagcaagaaaguuagauuugaaaauacugcuucagacaaggggaaaaauccuaguaaaguuauuaagagcuacuacggaaccauggacauuaagaaaauaaaugaaggguuauuggacagcaagauauuaagugcuuucaacacagugauagcacugcuuggauccauuguaaucauagugaugaauauaaugaucauccagaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuaucccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguguacaacaaugaauucuauuaugugcuuugugcagugucaguuguuggagacccuauucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguagguuuuuuggucaggacagaguucaaauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucaaccuguuuucuaccaagcgucuuuuucaugggacacuaugauuaaauuuggagauguccaaacaguuaacccuuuaguuguaaauuggcgugacaacacgguaaucucaagaccuggacaaucacaaugcccuagauucaacaagugcccagagguuugcugggaagggguuuauaaugaugccuuccugauugauagaaucaauuggauaagugcggguguauuccuugacagcaaccagaccgcagagaauccuguuuuuacuguauucaaagauaaugaaguacuuuacagagcacaacuagccuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 40 - RNA, 1809 nt, Artificial Sequence
  derived and/or modified CDS sequence (wt) from Nipah henipavirus__ACT32615__G
augccgacagaaagcaagaaaguuagauucgaaaauacugcuucagacaaggggaaaaauccuaguaaaguuaucaagagcuacuacggaaccauggacauuaagaaaauaaaugaaggguuauuggacagcaagauauuaagugcuuucaacacagugauagcacugcuuggauccauuguaaucauagugaugaauauaaugaucauccaaaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuaucccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguauacaacaaugaauucuauuaugugcuuugugcagugucaguuguuggagacccuguucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguagguuuuuuggucaggacagaguucaaauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucagccuguuuucuaccaagcgucuuuuucaugggacacuaugauuaaauuuggagauguccaaacaguuaacccuuuaguuguaaauuggcgugacaacacgguaaucucaagaccugggcaaucacaaugcccuagauucaacaagugcccagagguuugcugggaagggguuuauaaugaugccuuccugauugauagaaucaauuggauaagugcggguguauuccuugacagcaaccagaccgcagagaauccuguuuuuacuguauucaaagauaaugaaguacuuuacagagcacaacuagcuuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 41 - RNA, 1809 nt, Artificial Sequence
  derived and/or modified CDS sequence (wt) from Nipah henipavirus__CAF25497__G
augccggcagaaaacaagaaaguuagauucgaaaauacuacuucagacaaagggaaaaauccuaguaaaguuauuaagagcuacuacggaaccauggacauuaagaaaauaaaugaaggauuauuggacagcaaaauauuaagugcuuucaacacaguaauagcauugcuuggaucuaucgugaucauagugaugaauauaaugaucauccaaaauuacacaagaucaacagacaaucaggccgugaucaaagaugcguugcaagguauccaacagcagaucaaagggcuugcugacaaaaucggcacagagauagggcccaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacucccuuuuagagaguauaggccacagacagaaggggugagcaaucugguaggauuaccuaauaauauuugccugcaaaagacaucuaaucagauauugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucugggccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaguuguauucauugaaauaucugaucaaagauuaucuauuggaucuccuagcaaaaucuaugauucuuugggucaaccuguuuucuaccaagcgucauuuucaugggauacuaugauuaaauuuggagauguucuaacagucaacccucugguugucaauuggcguaauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuuuacuguauucaaagauaaugaaauacuuuauagggcacaacuggcuucugaggacaccaaugcacaaaaaacaauaacuaauuguuuucucuugaagaauaagauuuggugcauaucauugguugagauauaugacacaggagacaaugucauaagacccaaacuauucgcgguuaagauaccagagcaauguacauaa

SEQ ID NO: 42 - RNA, 1809 nt, Artificial Sequence
  derived and/or modified CDS sequence (wt) from Nipah henipavirus__CBM41034__G
augccggcagaaaacaagaaaguuagauucgaaaauacuacuucagacaaagggaaaaauccuaguaaaguuauuaagagcuacuacggaaccauggacauuaagaaaauaaaugaaggauuauuggacagcaaaauauuaagugcuuucaacacaguaauagcauugcuuggaucuaucgugaucauagugaugaauauaaugaucauccaaaauuacacaagaucaacagacaaucaggccgugaucaaagaugcguugcaggguauccaacagcagaucaaagggcuugcugacaaaaucggcacagagauagggccuaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacuccccuuuagagaguauaggccgcagacagaaggggugagcaaucugguaggauuaccugauaauauuugccugcaaaagacaucuaaucagauacugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucuggaccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaauuguauucauugaaauaucugaucaaagauuaucuauuggaucuccuagcaaagucuaugauucuuugggucaaccuguuuucuaccaagcgucauuuucaugggauacuaugauuaaauuuggagauguucaaacagucaacccucugguugucaauuggcgugauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuucacuguauucaaagauaaugaaauacuuuauagggcacaacuggcuucugaggacaccaaugcacaaaaaacaauaacuaauugcuuucucuugaagaauaagauuuggugcauaucauugguugagauauaugacacaggagacaaugucauaagacccaaacuauucgcgguuaagauaccagagcaauguacauaa

SEQ ID NO: 43 - RNA, 1809 nt, Artificial Sequence
  derived and/or modified CDS sequence (wt) from Nipah henipavirus__AAX51853__G
augccggcagaaagcaagaaaguuagauucgaaaauacuacuucagacaaagggaaaauuccuaguaaaauuauuaagagcuacuacggaaccauggacauuaagaaaauaaaugaaggauuauuggacagcaaaauauuaagugcuuucaacacaguaauagcauugcuuggaucuaucgugaucauagugaugaauauaaugaucauccaaaauuauacaagaucaacagacaaucaggccgugaucaaagaugcguugcaggguauccaacagcagaucaaagggcuugcugacaaaaucggcacagagauagggcccaaaguaucacugauugacacauccaguacuauuacuaucccagcuaacauugggcuguuagguucaaagaucagccagucgacugcaaguauaaaugagaaugugaaugaaaaauguaaauucacauugccucccuugaaaauccacgaauguaacauuucuugucccaacccacucccuuuuagagaguauaggccgcagacagaaggagugagcaaucugguaggauuaccuaauaauauuugccugcaaaagacaucuaaucagauacugaagccaaagcugauuucauacacuuuaccuguagucggucaaagugguaccuguaucacagacccauugcuggcuauggacgagggcuauuuugcauauagccaccuggaaagaaucggaucauguucaagaggggucuccaaacaaaaaauaauaggaguuggagagguacuagacagaggugaugaaguuccuucuuuauuuaugaccaaugucuggaccccaccaaauccaaacacuguuuaccacuguagugcuguauacaacaaugaauucuauuaugugcuuugugcagugucaacuguuggagacccuauucugaauagcaccuacugguccggaucucuaaugaugacccgucuagcuguaaaacccaagaguaaugauggggguuacaaucaacaucaacuugcccuacgaaguaucgagaaagggagguaugauaaagucaugccguauggaccuucaggcaucaaacagggugacacccuguauuuuccugcuguaggauuuuuggucaggacagaguucaaauacaaugauucaaauugucccaucacgaagugucaauacaguaaaccugaaaauugcaggcuaucuauggggauuagaccaaacagccauuauguccuucgaucuggacuauuaaaauacaaucuaucagauggggagaacccuaaaauuguauucauugaaauaucugaucaaagauuaucuauuggaucuccuagcaaaaucuaugauucuuugggucaaccuguuuucuaccaagcgucauuuucaugggauacuaugauuaaauuuggagauguucaaacagucaacccuuugguuguaaguuggcgugauaacacgguaauaucaagaccugggcaaucgcaaugcccuagauucaauacauguccagagaucugcugggaaggaguuuauaaugaugcauuccuaauugacagaaucaauuggauaagcgcagguguauuccuugacagcaaucagaccgcagaaaauccuguuuuuacuguauucaaagauaaugaaauacuuuauagagcacaacuggcuucugaggacaccaaugcacaaaaaacaauaacuaauugcuuucucuugaagaauaagauuuggugcauaucauugguugagauauaugacacaggagacaaugucauaagacccaaacuauucgcaguuaagauaccagagcaauguacauaa

SEQ ID NO: 44 - RNA, 1809 nt, Artificial Sequence
  derived and/or modified CDS sequence (wt) from Nipah henipavirus__AEZ01397__G
augccgacagaaagcaagaaaguuagauucgaaaauacugcuucagacaaggggaaaaauccuaguaaaguuauuaagagcuacuacggaaccauggacauuaagaaaauaaaugaaggguuauuggacagcaagauauuaagugcuuucaacacagugauagcacugcuuggauccauuguaaucauagugaugaauauaaugaucauccaaaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuauuccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguguacaacaaugaauucuauuaugugcuuugugcagugucaguuguuggagacccuauucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguaggauuuuuggucaggacagaguucacauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucaaccuguuuucuaccaagcaucuuuuucaugggacacuaugauuaaauuuggagauguccaaacaguuaacccuuuaguuguaaauuggcgugacaacacgguaaucucaagaccugggcaaucacaaugcccuagauucaacaagugcccagagguuugcugggaagggguuuauaaugaugcuuuccugauugauagaaucaauuggauaagcgcggguguauuccuugacagcaaccagaccgcagagaauccuguuuuuacuguauucaaagauaaugaaguacuuuacagagcacaacuagcuuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 45 - RNA, 1815 nt, Artificial Sequence
  derived and/or modified CDS sequence (wt) from Hendra henipavirus__NP_047112__G
augauggcugauuccaaauugguaagccugaacaauaaucuaucugguaaaaucaaggaucaagguaaaguuaucaagaauuauuacggcacaauggacaucaagaaaauuaacgauggguuauuagauaguaagauacuuggggcguuuaacacagugauagcuuuguugggaucaaucaucaucauugugaugaauaucaugauaauucaaaauuacaccagaacgacugauaaucaggcacuaaucaaagagucacuccagaguguacagcaacaaaucaaagcuuuaacagacaaaaucgggacagagauaggccccaaagucucacuaauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaacuaaaguugaaagagggaaguacgauaaggugaugccuuacgguccaucagguaucaagcaaggggauacauuguacuuuccggccgucgguuuuuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucuaucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuauuugcagucaagauaccugcccaauguucagagaguuga

SEQ ID NO: 46 - RNA, 1815 nt, Artificial Sequence
  derived and/or modified CDS sequence (wt) from Hendra henipavirus__AEB21225__G
augauggcugauuccaaauugguaagccugaacaauaaucuaucugguaaaaucaaggaucaagguaaaguuaucaagaauuauuacggcacaauggacaucaagaaaauuaacgauggguuauuagauaguaagauacuuggggcguuuaacacagugauagcuuuguugggaucaaucaucaucauugugaugaauaucaugauaauucaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacgucaacaaucuuaaagcccaggcugauauccuauacucuaccaauuaauaccagagaagggguuugcaucacugacccacuuuuggcuguugauaauggcuucuucgccuauagccaucuugaaaagaucggaucaugcacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaauggguguuaacuccaaaagucauuauauuuugagaucaggacuauugaaguauaaucugucucuuggaggagacaucacacuccaauuuaucgagauugcugacaauagauugaccaucgguucuccuaguaagauauacaauucucuaggucaaccugucuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 47 - RNA, 1815 nt, Artificial Sequence
  derived and/or modified CDS sequence (wt) from Hendra henipavirus__AEB21216__G
augauggcugauuccaaauugguaagcccgaacaauaaucuaucugguaaaaucaaggaucaagguaaaguuaucaagaauuauuacggcacaauggacaucaagaaaauuaacgauggguuauuagauaguaagauacuuggggcguuuaacacagugauagcuuuguugggaucaaucaucaucauugugaugaauaucaugauaauucaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaauccuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucacugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaaauaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucgaugggugucaacuccaaaagucauuauauuuugagaucaggacuauugaaguauaaucugucucuaggaggagacaucauacuucaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 48 - RNA, 1815 nt, Artificial Sequence
  derived and/or modified CDS sequence (wt) from Hendra henipavirus__AEB21206__G
augauggcugauuccaaauugguaagccugaacaauaaucuaucugguaaaaucaaggaucaagguaaaguuaucaagaauuauuacggcacaauggacaucaagaaaauuaacgauggguuauuagauaguaagauacuuggggcguuuaacacagugauagcuuuguugggaucaaucaucaucauugugaugaauaucaugauaauucaaaauuacaccagaacgacugauaaucaggcacuaaucaaagagucgcuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggaaacuacaaucagaaauacaucgcuauaacuaaaguugaaagagggaaguacgauaaggugaugccuuacgguccaucagguaucaagcaaggggauacauuguacuuuccggccgucgguuuuuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucuaucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauauugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuauuugcagucaagauaccugcccaauguucagagaguuga

SEQ ID NO: 49 - RNA, 1815 nt, Artificial Sequence
  derived and/or modified CDS sequence (wt) from Hendra henipavirus__AEQ38052__G
augauggcugauuccaaauugguaagccugaacaauaaucuaucugguaaaaucaaggaucaagguaaaguuaucaagaauuauuacggcacaauggacaucaagaaaauuaacgauggguuauuagauaguaagauacuuggggcguuuaacacagugauagcuuuguugggaucaaucaucaucauugugaugaauaucaugauaauucaaaacuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucacuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugcuguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 50 - RNA, 1815 nt, Artificial Sequence
  derived and/or modified CDS sequence (wt) from Hendra henipavirus__AEQ38115__G
augauggcugauuccaaauugguaagccugaacaauaaucuaucugguaaaaucaaggaucaagguaaaguuaucaagaauuauuacggcacaauggacaucaagaaaauuaacgauggguuauuagauaguaagauacuuggggcguuuaacacagugauagcuuuguugggaucaaucaucaucauugugaugaauaucaugauaauucaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuaggggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcaguaucccaugugggagauccuauccuuaacaguacuuccuggacagagucacugucucugauucgucuugcuguaagaccaaaaagugauaauggagacuacaaucagaaauacaucgcuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucucuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 51 - RNA, 1815 nt, Artificial Sequence
  derived and/or modified CDS sequence (wt) from Hendra henipavirus__AEQ38108__G
augauggcugauuccaaauugguaagccugaacaauaaucuaucugguaaaaucaaggaucaagguaaaguuaucaagaauuauuacggcacaauggacaucaagaaaauuaacgauggguuauuagauaguaagauacuuggggcguuuaacacagugauagcuuuguugggaucaaucaucaucauugugaugaauaucaugauaauucaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucacuauaacuaaaguugaaagagggaaguacgauaaggugaugccuuacgguccaucagguaucaagcaagggaauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugcuguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 52 - RNA, 1815 nt, Artificial Sequence
  derived and/or modified CDS sequence (wt) from Hendra henipavirus__AAV80426__G
augauggccgacagcaagcuggugagccugaacaacaaccugagcggcaagaucaaggaccagggcaaagugaucaagaacuacuacggcaccauggacaucaagaagaucaacgacggccugcuggacucuaagauccugggcgccuucaacacagugaucgcccugcugggcagcaucaucaucaucgugaugaacaucaugaucauccagaacuacacccggaccaccgauaaucaggcccugaucaaggagagccugcagucugugcagcagcagaucaaggcccugaccgacaagaucggcacagagaucggcccuaaagugagccugaucgacaccagcagcaccaucaccauccccgccaauaucggacugcugggcuccaagaucagccagugcaccagcuccaucaacgagaacgugaacgacaagugcaaguucacccugcccccccugaagauccacgagugcaacaucagcugccccaacccccugcccuucagagaguacaggcccaucagccagggagugagcgaucuggugggccugcccaaucagaucugccugcagaaaaccaccuccaccauccugaagccccggcugaucagcuacacccugcccaucaacacaagagagggcgugugcaucaccgauccucugcuggccguggacaacggcuucuucgccuacagccaccuggagaagaucggcagcugcacaagaggcaucgccaagcagagaaucaucggcgugggcgaagugcuggacagaggcgacaaagugcccagcauguucaugaccaacguguggacccccccuaauccuagcaccauccaccacugcagcagcaccuaccacgaggacuucuacuacacccugugcgccgugucucaugugggcgaccccauccugaauagcaccagcuggaccgagagccugucccugauuagacuggccgugaggcccaagagcgauagcggcgacuacaaccagaaguacaucgccaucaccaaaguggagcggggcaaguacgacaaagugaugcccuauggccccagcggaaucaagcagggcgacacccuguacuuucccgccgugggcuuucugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugacaaucggcagccccagcaagaucuacaacagccugggccagcccguguuuuaccaggccagcuacagcugggacaccaugaucaagcugggcgauguggacacaguggacccccugagagugcaguggcggaacaacagcgugaucagcagaccuggccagagccagugccccagauucaacgugugccccgaaguguguugggagggcagcuacaacgacgccuuccugaucgaccggcugaauugggugagcgccggaguguaccugaacagcaaccagaccgccgagaacccuguguucgccguguucaaggacaacgagauccuguaccaagugccccuggccgaggaugauaccaacgcccagaaaaccaucaccgacugcuuccugcuggagaacgugaucuggugcaucagccugguggagaucuacgacaccggcgacagcgugauuaggcccaagcuguucgcugugaagaucccugcccagugcagcgagagcuga

SEQ ID NO: 53 - RNA, 1641 nt, Artificial Sequence
  derived and/or modified CDS sequence (opt1) from Nipah henipavirus__AAK50553__F
augguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccuga

SEQ ID NO: 54 - RNA, 1641 nt, Artificial Sequence
  derived and/or modified CDS sequence (opt1) from Nipah henipavirus__AEZ01388__F
auggccgugauccugaacaagcgcuacuacagcaaccuccugauccugauccucaucaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccuga

SEQ ID NO: 55 - RNA, 1641 nt, Artificial Sequence
  derived and/or modified CDS sequence (opt1) from Nipah henipavirus__AAY43915__F
auggccgugauccugaacaagcgcuacuacagcaaccuccugauccugauccucaugaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccuga

SEQ ID NO: 56 - RNA, 1641 nt, Artificial Sequence
  derived and/or modified CDS sequence (opt1) from Nipah henipavirus__CAF25496__F
augguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacguga

SEQ ID NO: 57 - RNA, 1641 nt, Artificial Sequence
  derived and/or modified CDS sequence (opt1) from Nipah henipavirus__AAM13405__F
augguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccuga

SEQ ID NO: 58 - RNA, 1641 nt, Artificial Sequence
  derived and/or modified CDS sequence (opt1) from Nipah henipavirus__CBM41033__F
augguggucauccuggacaagcgcugcuacagcaaccuccugauccugauccucaugaucuccgagugcagcgugggcauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccuga

SEQ ID NO: 59 - RNA, 1641 nt, Artificial Sequence
  derived and/or modified CDS sequence (opt1) from Nipah henipavirus__AEZ01396__F
auggccgugauccugaacaagcgcuacuacagcaaccuccugauccugauccucaugaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccuga

SEQ ID NO: 60 - RNA, 1641 nt, Artificial Sequence
  derived and/or modified CDS sequence (opt1) from Hendra henipavirus__NP_047111__F
auggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacguga

SEQ ID NO: 61 - RNA, 1641 nt, Artificial Sequence
  derived and/or modified CDS sequence (opt1) from Hendra henipavirus__AEB21233__F
auggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccuga

SEQ ID NO: 62 - RNA, 1641 nt, Artificial Sequence
  derived and/or modified CDS sequence (opt1) from Hendra henipavirus__AEQ38114__F
auggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccuga

SEQ ID NO: 63 - RNA, 1641 nt, Artificial Sequence
  derived and/or modified CDS sequence (opt1) from Hendra henipavirus__AAB39505__F
auggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccuga

SEQ ID NO: 64 - RNA, 1809 nt, Artificial Sequence
  derived and/or modified CDS sequence (opt1) from Nipah henipavirus__AAK50554__G
augcccgccgagaacaagaaggugcgcuucgagaacaccaccagcgacaagggcaagaucccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccuga

SEQ ID NO: 65 - RNA, 1809 nt, Artificial Sequence
  derived and/or modified CDS sequence (opt1) from Nipah henipavirus__AEZ01389__G
augcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccuga

SEQ ID NO: 66 - RNA, 1809 nt, Artificial Sequence
  derived and/or modified CDS sequence (opt1) from Nipah henipavirus__ACT32615__G
augcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccuga

SEQ ID NO: 67 - RNA, 1809 nt, Artificial Sequence
  derived and/or modified CDS sequence (opt1) from Nipah henipavirus__CAF25497__G
augcccgccgagaacaagaaggugcgcuucgagaacaccaccagcgacaagggcaagaacccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccuga

SEQ ID NO: 68 - RNA, 1809 nt, Artificial Sequence
  derived and/or modified CDS sequence (opt1) from Nipah henipavirus__CBM41034__G
augcccgccgagaacaagaaggugcgcuucgagaacaccaccagcgacaagggcaagaacccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccuga

SEQ ID NO: 69 - RNA, 1809 nt, Artificial Sequence
  derived and/or modified CDS sequence (opt1) from Nipah henipavirus__AAX51853__G
augcccgccgagagcaagaaggugcgcuucgagaacaccaccuccgacaagggcaagaucccgagcaagaucaucaaguccuacuacgggacgauggacaucaagaagaucaacgagggccugcucgacagcaagauccuguccgccuucaacaccgucaucgcgcugcucgggagcaucgugaucaucgugaugaacaucaugaucauccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccuga

SEQ ID NO: 70 - RNA, 1809 nt, Artificial Sequence
  derived and/or modified CDS sequence (opt1) from Nipah henipavirus__AEZ01397__G
augcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacguga

SEQ ID NO: 71 - RNA, 1815 nt, Artificial Sequence
  derived and/or modified CDS sequence (opt1) from Hendra henipavirus__NP_047112__G
augauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcuga

SEQ ID NO: 72 - RNA, 1815 nt, Artificial Sequence
  derived and/or modified CDS sequence (opt1) from Hendra henipavirus__AEB21225__G
augauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcuga

SEQ ID NO: 73 - RNA, 1815 nt, Artificial Sequence
  derived and/or modified CDS sequence (opt1) from Hendra henipavirus__AEB21216__G
augauggccgacagcaagcuggugucccccaacaacaaccucagcggcaagaucaaggaccaggggaaggucaucaagaacuacuacggcaccauggacaucaagaagaucaacgacgggcugcuggacuccaagauccucggcgccuucaacaccgugaucgcgcugcuggggagcaucaucaucaucgugaugaacaucaugaucauccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcuga

SEQ ID NO: 74 - RNA, 1815 nt, Artificial Sequence
  derived and/or modified CDS sequence (opt1) from Hendra henipavirus__AEB21206__G
augauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcuga

SEQ ID NO: 75 - RNA, 1815 nt, Artificial Sequence
  derived and/or modified CDS sequence (opt1) from Hendra henipavirus__AEQ38052__G
augauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcuga

SEQ ID NO: 76 - RNA, 1815 nt, Artificial Sequence
  derived and/or modified CDS sequence (opt1) from Hendra henipavirus__AEQ38115__G
augauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccuga

SEQ ID NO: 77 - RNA, 1815 nt, Artificial Sequence
  derived and/or modified CDS sequence (opt1) from Hendra henipavirus__AEQ38108__G
augauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcuga

SEQ ID NO: 78 - RNA, 1815 nt, Artificial Sequence
  derived and/or modified CDS sequence (opt1) from Hendra henipavirus__AAV80426__G
augauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcuga

SEQ ID NO: 79 - RNA, 1641 nt, Artificial Sequence
  derived and/or modified CDS sequence (opt2) from Nipah henipavirus__AAK50553__F
auggucgucauccucgacaagcgcugcuacugcaaccuccucauccucauccucaugaucuccgagugcuccgucggcauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 80 - RNA, 1641 nt, Artificial Sequence
  derived and/or modified CDS sequence (opt2) from Nipah henipavirus__AEZ01388__F
auggccgucauccucaacaagcgcuacuacuccaaccuccucauccucauccucaucaucuccgagugcuccgucggcauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 81 - RNA, 1641 nt, Artificial Sequence
  derived and/or modified CDS sequence (opt2) from Nipah henipavirus__AAY43915__F
auggccgucauccucaacaagcgcuacuacuccaaccuccucauccucauccucaugaucuccgagugcuccgucggcauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguacuccuccgaccuccucuucgucuucggccccaaccuccaggaccccgucuccaacuccaugaccauccaggccaucucccaggccuucggcggcaacuacgagacccuccuccgcacccucggcuacgccaccgagggcuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 82 - RNA, 1641 nt, Artificial Sequence
  derived and/or modified CDS sequence (opt2) from Nipah henipavirus__CAF25496__F
auggucgucauccucgacaagcgcugcuacugcaaccuccucauccucauccucaugaucuccgagugcuccgucggcauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaucgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 83 - RNA, 1641 nt, Artificial Sequence
  derived and/or modified CDS sequence (opt2) from Nipah henipavirus__AAM13405__F
auggucgucauccucgacaagcgcugcuacugcaaccuccucauccucauccucaugaucuccgagugcuccgucggcauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaccaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 84 - RNA, 1641 nt, Artificial Sequence
  derived and/or modified CDS sequence (opt2) from Nipah henipavirus__CBM41033__F
auggucgucauccucgacaagcgcugcuacuccaaccuccucauccucauccucaugaucuccgagugcuccgucggcauccuccacuacgagaagcucuccaagaucggccucgucaagggcgucacccgcaaguacaagaucaaguccaacccccucaccaaggacaucgucaucaagaugaucgccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaaguccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 85 - RNA, 1641 nt, Artificial Sequence
  derived and/or modified CDS sequence (opt2) from Nipah henipavirus__AEZ01396__F
auggccgucauccucaacaagcgcuacuacuccaaccuccucauccucauccucaugaucuccgagugcuccgucggcauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 86 - RNA, 1641 nt, Artificial Sequence
  derived and/or modified CDS sequence (opt2) from Hendra henipavirus__NP_047111__F
auggccacccaggagguccgccucaagugccuccucugcggcaucaucguccucguccucucccucgagggccucggcauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucgccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 87 - RNA, 1641 nt, Artificial Sequence
  derived and/or modified CDS sequence (opt2) from Hendra henipavirus__AEB21233__F
auggccacccaggagguccgccucaagugccuccucugcggcaucaucguccucguccucucccucgagggccucggcauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 88 - RNA, 1641 nt, Artificial Sequence
  derived and/or modified CDS sequence (opt2) from Hendra henipavirus__AEQ38114__F
auggccacccaggagguccgccucaagugccuccucugcggcaucaucguccucguccucucccucgagggccucggcauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucaucaucgucgagaagaagcgcggcaacuacucccgccucgacgaccgccagguccgccccgucuccaacggcgaccucuacuacaucggcaccuga

SEQ ID NO: 89 - RNA, 1641 nt, Artificial Sequence
  derived and/or modified CDS sequence (opt2) from Hendra henipavirus__AAB39505__F
auggccacccaggagguccgccucaagugccuccucugcggcaucaucguccucguccucucccucgagggccucggcauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccuccucaucugcuccugcuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccagucccgcgagcagacccuccucaugaucgacaacaccaccugcaccaccgucguccucggcaacaucaucaucucccuccccaaguaccucggcuccaucaagcuccagguccuccgcgcccuccuccucggccaccaguccauccagaccaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 90 - RNA, 1809 nt, Artificial Sequence
  derived and/or modified CDS sequence (opt2) from Nipah henipavirus__AAK50554__G
augcccgccgagaacaagaagguccgcuucgagaacaccaccuccgacaagggcaagauccccuccaaggucaucaaguccuacuacggcaccauggacaucaagaagaucaacgagggccuccucgacuccaagauccucuccgccuucaacaccgucaucgcccuccucggcuccaucgucaucaucgucaugaacaucaugaucauccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaaggucgucuucaucgagaucuccgaccagcgccucuccaucggcucccccuccaagaucuacgacucccucggccagcccgucuucuaccaggccuccuucuccugggacaccaugaucaaguucggcgacguccucaccgucaacccccucgucgucaacuggcgcaacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 91 - RNA, 1809 nt, Artificial Sequence
  derived and/or modified CDS sequence (opt2) from Nipah henipavirus__AEZ01389__G
augcccaccgaguccaagaagguccgcuucgagaacaccgccuccgacaagggcaagaaccccuccaaggucaucaaguccuacuacggcaccauggacaucaagaagaucaacgagggccuccucgacuccaagauccucuccgccuucaacaccgucaucgcccuccucggcuccaucgucaucaucgucaugaacaucaugaucauccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccauccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaaguacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 92 - RNA, 1809 nt, Artificial Sequence
  derived and/or modified CDS sequence (opt2) from Nipah henipavirus__ACT32615__G
augcccaccgaguccaagaagguccgcuucgagaacaccgccuccgacaagggcaagaaccccuccaaggucaucaaguccuacuacggcaccauggacaucaagaagaucaacgagggccuccucgacuccaagauccucuccgccuucaacaccgucaucgcccuccucggcuccaucgucaucaucgucaugaacaucaugaucauccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccguccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaaguacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 93 - RNA, 1809 nt, Artificial Sequence
  derived and/or modified CDS sequence (opt2) from Nipah henipavirus__CAF25497__G
augcccgccgagaacaagaagguccgcuucgagaacaccaccuccgacaagggcaagaaccccuccaaggucaucaaguccuacuacggcaccauggacaucaagaagaucaacgagggccuccucgacuccaagauccucuccgccuucaacaccgucaucgcccuccucggcuccaucgucaucaucgucaugaacaucaugaucauccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucugggccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaaggucgucuucaucgagaucuccgaccagcgccucuccaucggcucccccuccaagaucuacgacucccucggccagcccgucuucuaccaggccuccuucuccugggacaccaugaucaaguucggcgacguccucaccgucaacccccucgucgucaacuggcgcaacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 94 - RNA, 1809 nt, Artificial Sequence
  derived and/or modified CDS sequence (opt2) from Nipah henipavirus__CBM41034__G
augcccgccgagaacaagaagguccgcuucgagaacaccaccuccgacaagggcaagaaccccuccaaggucaucaaguccuacuacggcaccauggacaucaagaagaucaacgagggccuccucgacuccaagauccucuccgccuucaacaccgucaucgcccuccucggcuccaucgucaucaucgucaugaacaucaugaucauccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccgacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaagaucgucuucaucgagaucuccgaccagcgccucuccaucggcucccccuccaaggucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 95 - RNA, 1809 nt, Artificial Sequence
  derived and/or modified CDS sequence (opt2) from Nipah henipavirus__AAX51853__G
augcccgccgaguccaagaagguccgcuucgagaacaccaccuccgacaagggcaagauccccuccaagaucaucaaguccuacuacggcaccauggacaucaagaagaucaacgagggccuccucgacuccaagauccucuccgccuucaacaccgucaucgcccuccucggcuccaucgucaucaucgucaugaacaucaugaucauccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagaagaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacgacggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacguccuccgcuccggccuccucaaguacaaccucuccgacggcgagaaccccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucuccuggcgcgacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 96 - RNA, 1809 nt, Artificial Sequence
  derived and/or modified CDS sequence (opt2) from Nipah henipavirus__AEZ01397__G
augcccaccgaguccaagaagguccgcuucgagaacaccgccuccgacaagggcaagaaccccuccaaggucaucaaguccuacuacggcaccauggacaucaagaagaucaacgagggccuccucgacuccaagauccucuccgccuucaacaccgucaucgcccuccucggcuccaucgucaucaucgucaugaacaucaugaucauccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccauccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaccuacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 97 - RNA, 1815 nt, Artificial Sequence
  derived and/or modified CDS sequence (opt2) from Hendra henipavirus__NP_047112__G
augauggccgacuccaagcucgucucccucaacaacaaccucuccggcaagaucaaggaccagggcaaggucaucaagaacuacuacggcaccauggacaucaagaagaucaacgacggccuccucgacuccaagauccucggcgccuucaacaccgucaucgcccuccucggcuccaucaucaucaucgucaugaacaucaugaucauccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 98 - RNA, 1815 nt, Artificial Sequence
  derived and/or modified CDS sequence (opt2) from Hendra henipavirus__AEB21225__G
augauggccgacuccaagcucgucucccucaacaacaaccucuccggcaagaucaaggaccagggcaaggucaucaagaacuacuacggcaccauggacaucaagaagaucaacgacggccuccucgacuccaagauccucggcgccuucaacaccgucaucgcccuccucggcuccaucaucaucaucgucaugaacaucaugaucauccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucacccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 99 - RNA, 1815 nt, Artificial Sequence
  derived and/or modified CDS sequence (opt2) from Hendra henipavirus__AEB21216__G
augauggccgacuccaagcucgucucccccaacaacaaccucuccggcaagaucaaggaccagggcaaggucaucaagaacuacuacggcaccauggacaucaagaagaucaacgacggccuccucgacuccaagauccucggcgccuucaacaccgucaucgcccuccucggcuccaucaucaucaucgucaugaacaucaugaucauccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaacaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 100 - RNA, 1815 nt, Artificial Sequence
  derived and/or modified CDS sequence (opt2) from Hendra henipavirus__AEB21206__G
augauggccgacuccaagcucgucucccucaacaacaaccucuccggcaagaucaaggaccagggcaaggucaucaagaacuacuacggcaccauggacaucaagaagaucaacgacggccuccucgacuccaagauccucggcgccuucaacaccgucaucgcccuccucggcuccaucaucaucaucgucaugaacaucaugaucauccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcaacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacaucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 101 - RNA, 1815 nt, Artificial Sequence
  derived and/or modified CDS sequence (opt2) from Hendra henipavirus__AEQ38052__G
augauggccgacuccaagcucgucucccucaacaacaaccucuccggcaagaucaaggaccagggcaaggucaucaagaacuacuacggcaccauggacaucaagaagaucaacgacggccuccucgacuccaagauccucggcgccuucaacaccgucaucgcccuccucggcuccaucaucaucaucgucaugaacaucaugaucauccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucaccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 102 - RNA, 1815 nt, Artificial Sequence
  derived and/or modified CDS sequence (opt2) from Hendra henipavirus__AEQ38115__G
augauggccgacuccaagcucgucucccucaacaacaaccucuccggcaagaucaaggaccagggcaaggucaucaagaacuacuacggcaccauggacaucaagaagaucaacgacggccuccucgacuccaagauccucggcgccuucaacaccgucaucgcccuccucggcuccaucaucaucaucgucaugaacaucaugaucauccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacaacggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 103 - RNA, 1815 nt, Artificial Sequence
  derived and/or modified CDS sequence (opt2) from Hendra henipavirus__AEQ38108__G
augauggccgacuccaagcucgucucccucaacaacaaccucuccggcaagaucaaggaccagggcaaggucaucaagaacuacuacggcaccauggacaucaagaagaucaacgacggccuccucgacuccaagauccucggcgccuucaacaccgucaucgcccuccucggcuccaucaucaucaucgucaugaacaucaugaucauccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucaccaucaccaaggucgagcgcggcaaguacgacaaggucaugcccuacggccccuccggcaucaagcagggcaacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 104 - RNA, 1815 nt, Artificial Sequence
  derived and/or modified CDS sequence (opt2) from Hendra henipavirus__AAV80426__G
augauggccgacuccaagcucgucucccucaacaacaaccucuccggcaagaucaaggaccagggcaaggucaucaagaacuacuacggcaccauggacaucaagaagaucaacgacggccuccucgacuccaagauccucggcgccuucaacaccgucaucgcccuccucggcuccaucaucaucaucgucaugaacaucaugaucauccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccagugcaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcuccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 105 - RNA, 1641 nt, Artificial Sequence
  derived and/or modified CDS sequence (opt3) from Nipah henipavirus__AAK50553__F
augguggucauccuggacaagagaugcuacuguaaccuccuuauucugauauugaugaucagcgagugcuccguuggcauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaccgaggacuuugaugaccugcucgagagugauagcaucacaggucagauaauuuacguggaccuuucuuccuauuacaucaucguacguguguauuucccaauucugaccgaaauccaacaggccuacauucaggaguugcuacccgucucauuuaacaaugacaacagcgaauggauaaguaucgugccuaauuucauucugguuagaaacacgcucaucucuaauaucgagauuggcuuuugucugauaacuaagagguccgugaucugcaaccaggauuaugcaacaccaaugaccaauaacaugcgggaaugucuuacugggagcacagagaaaugcccccgcgagcuggucgugucgucucacguaccuagauucgcuuuguccaauggaguucucuuugccaacuguauuucagugaccugccaaugucagacgaccggcagggcgaucagucagagcggugaacaaacacuguuaaugauugacaauacuaccugcccaacagccguccuggggaacgugaucauaucccuaggaaaguaccucggcucugucaauuacaacagcgagggcaucgcaauugggccgcccguguucacugauaagguugacaucucaagucagauuuccagcaugaaucagucucugcagcaaucaaaagauuauaucaaggaagcucagcggcuuuuggacaccgugaacccuagucugauaagcaugcucuccaugauuauccuguacguacuuucuauugccucgcugugcaucggauugauaacauuuaucagcuucauuaucgucgagaaaaagcgcaacaccuauucccgacucgaagauagaagggugcggccaacuucaaguggugaccuguacuauauuggcacguga

SEQ ID NO: 106 - RNA, 1641 nt, Artificial Sequence
  derived and/or modified CDS sequence (opt3) from Nipah henipavirus__AEZ01388__F
auggccgugauccugaacaagagauacuauagcaaucuccuuauucugauauugaucauuuccgagugcucugucggcaucuuacacuacgaaaaacugucaaagauugggcuaguuaaaggaaucaccaggaaguauaaaauaaagaguaacccccucacaaaggacaucgugauuaaaaugaucccuaauguaagcaacaugucccaguguacugguucugugauggagaauuacaagacgcggcugaacggcauucuuaccccaaucaaaggggcucuggaaauauauaagaauaacacacaugauuuggucggagacgugcgccucgcaggcguuauuauggccgguguggcgaucgggauugcuacugccgcacaaaucaccgccggagucgcucuguacgaggcaaugaaaaaugccgauaacaucaauaagcugaagucgucaauugaaagcacaaacgaggcugugguaaaacuccaggagaccgccgaaaagacuguuuauguguuaacagcgcugcaggacuacauaaauaccaaccuugucccgacgaucgauaaaauuaguugcaagcagacugaguugucccuggaccuagcacucucuaaauaccugagcgaucuucuguucguguuuggccccaauuugcaagacccuguguccaacucaaugaccauccaggccauaagucaggcuuucggcgggaacuaugaaacacuccugcgaacuuuaggauacgccaccgaggauuuugacgaucugcucgagagcgacucuauuacaggucagaucaucuaugucgaucuuuccggcuacuauauuaucguucguguguacuucccaauucugaccgaaauacaacaggcauauauccaggaguugcuacccguaucauuuaauaacgacaauagcgaauggauuaguaucgugccuaacuucauccuggucagaaauacgcucauuucuaacauagagaucggguuuugucugauuacuaagagguccgugaucugcaaucaggacuacgcuacaccaaugaccaacaauaugcgggaaugucuuacuggaagcacagagaaaugcccccgcgagcugguugugucgucucacgucccuagauucgccuuguccaacggcgugcucuuugcgaauuguauuucaguaaccugccaaugucagacgaccgguagggccaucagucagagcggggaacaaacacuguuaaugauagauaacacuaccugcccaacagcaguucugggaaaugugaucauuucccuaggcaaguaccucggcucugucaacuauaauagcgaggggaucgcuauuggaccgcccguguucacugacaaggucgauaucucaagucagauauccagcaugaaccagucucugcagcaaucaaaagacuacauuaaggaagcccagcggcuuuuggauaccgugaacccuagucugaucagcaugcucuccaugauuauccuguauguucuuucuauagcuucgcuguguaucgguuugauuacauuuaucagcuucauuaucguggagaaaaagcgcaauaccuacucccgacucgaagacagaaggguacggccaacuucaaguggcgaucuguauuacauagggacguga

SEQ ID NO: 107 - RNA, 1641 nt, Artificial Sequence
  derived and/or modified CDS sequence (opt3) from Nipah henipavirus__AAY43915__F
auggccgugauccugaacaagagauacuauagcaaucuccuuauucugauauugaugaucuccgagugcucugucggcauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauacagcuccgaucugcuuuucguguuuggccccaaucugcaagacccugugucaaacaguaugaccauucaggccaucagccaggcuuucggcgggaacuaugaaacauugcuccgaacucugggauacgccaccgaggguuuugaugacuuacuggagucugauuccauaacaggccagauuaucuaugucgaccucucaggguacuauaucauuguucguguguacuucccaauccuuaccgaaauucaacaggcauauauacaggagcuguugcccguaaguuuuaauaacgauaauagugaauggaucucuauugugccuaacuucauccuagucagaaauacgcugaucuccaacauugagauaggauuuugucucaucacuaagaggagcgugauuugcaaucaggacuacgcuacaccaaugaccaacaauaugcgggaaugucugacuggcucgacagagaaaugcccccgcgagcuuguugugucuucccacgucccuagauucgcccugucaaacgguguguuguuugcgaauuguaucaguguaaccugccaaugucagacgaccgggagggccauuagccaguccggagaacaaacacuccugaugaucgacaacacuaccugcccaacagcaguuuuaggcaaugugauaaucucucugggcaaguaccuagggagcgucaacuauaauucagagggaauugcuaucgguccgcccguguucacugauaaggucgacauuaguucccagaucagcucuaugaaccagucacuccagcaaaguaaagauuacauaaaggaagcccagcggcugcuugacaccgugaacccuagcuugauuuccaugcugucuaugaucauucucuauguucugucgaucgcuagccuuuguauaggccugaucacauuuauuuccuucaucauuguggagaaaaagcgcaauaccuacucacgauuggaagauagaaggguacggccaacuagcucuggggaccucuauuacaucggaacguga

SEQ ID NO: 108 - RNA, 1641 nt, Artificial Sequence
  derived and/or modified CDS sequence (opt3) from Nipah henipavirus__CAF25496__F
augguggucauccuggacaagagaugcuacuguaaccuccuuauucugauauugaugaucagcgagugcuccguuggcauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaucgaggacuuugaugaccugcucgagagugauagcauaaccggucagauuaucuacguggaccuuucuuccuauuacaucauuguacguguguauuucccaauccugacagaaauucaacaggccuacauacaggaguugcuacccgucucauuuaacaaugacaacagcgaauggaucaguauugugccuaauuucauccugguuagaaacacccucaucucuaauauugagauaggcuuuugucugaucacgaagagguccgugauuugcaaccaggauuaugcaacuccaaugacaaauaacaugcgggaaugucuuaccgggagcacugagaaaugcccccgcgagcuggucgugucgucucacguaccuagauucgcuuuguccaauggaguucucuuugccaacuguaucucagugacaugccaaugucagaccacgggcagggcgauuagucagagcggugaacaaacccuguuaaugaucgacaauacaacuugcccaaccgccguccuggggaacgugauaaucucccuaggaaaguaccucggcucugucaauuacaacagcgagggcauugcaaucgggccgcccguguucacagauaagguugacauuucaagucagaucuccagcaugaaucagucucugcagcaaucaaaagauuauauaaaggaagcucagcggcuuuuggacacugugaacccuagucugauuagcaugcucuccaugaucauucuguacguacuuucuaucgccucgcugugcauaggauugaucaccuuuauuagcuucaucauugucgagaaaaagcgcaacacauauucccgacucgaagauagaagggugcggccaaccucaaguggugaccuguacuauaucggcacuuga

SEQ ID NO: 109 - RNA, 1641 nt, Artificial Sequence
  derived and/or modified CDS sequence (opt3) from Nipah henipavirus__AAM13405__F
augguggucauccuggacaagagaugcuacuguaaccuccuuauucugauauugaugaucagcgagugcuccguuggcauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaccgaggacuuugaugaccugcucgagagugauagcaucacaggucagauaauuuacguggaccuuucuuccuauuacaucaucguacguguguauuucccaauucugaccgaaauccaacaggccuacauucaggaguugcuacccgucucauuuaacaaugacaacagcgaauggauaaguaucgugccuaauuucauucugguuagaaacacgcucaucucuaauaucgagauuggcuuuugucugauaacuaagagguccgugaucugcaaccaggauuaugcaacaccaaccacuaauaacaugcgggaaugucuuacagggagcaccgagaaaugcccccgcgagcuggucgugucgucucacguaccuagauucgcuuuguccaauggaguucucuuugccaacuguauuucagugacgugccaaugucagaccacaggcagggcgaucagucagagcggugaacaaacucuguuaaugauugacaauaccacaugcccaacugccguccuggggaacgugaucauaucccuaggaaaguaccucggcucugucaauuacaacagcgagggcaucgcaauugggccgcccguguucaccgauaagguugacaucucaagucagauuuccagcaugaaucagucucugcagcaaucaaaagauuauaucaaggaagcucagcggcuuuuggacacagugaacccuagucugauaagcaugcucuccaugauuauccuguacguacuuucuauugccucgcugugcaucggauugauaaccuuuaucagcuucauuaucgucgagaaaaagcgcaacacuuauucccgacucgaagauagaagggugcggccaacgucaaguggugaccuguacuauauuggcacauga

SEQ ID NO: 110 - RNA, 1641 nt, Artificial Sequence
  derived and/or modified CDS sequence (opt3) from Nipah henipavirus__CBM41033__F
augguggucauccuggacaagagaugcuacagcaaccuccuuauucugauauugaugaucuccgaguguucuguuggcauuuuacacuaugaaaaacugucaaagaucgggcuagugaaaggaguaaccaggaaguacaaaauuaagaguaauccccucacaaaggauaucgugauaaaaaugaucgccaacgucagcaauaugucccagugcacugguucugugauggagaacuauaagacgcggcugaauggcauucuuaccccuaucaaaggggcucuggaaauuuacaagaacaauacacaugacuugguuggagaugugcgccucgcaggcgucaucauggccgguguggcgauagggauugcuacugccgcacaaaucaccgccggaguagcucuguaugaggcaaugaaaaacgccgacaauauuaacaagcugaagucgucaaucgaaagcacaaaugaggcuguugugaaacuccaggagaccgccgaaaagacugucuacguguuaacagcgcugcaggauuauaucaacaccaaucuugugccaacgauugacaaaauaaguuguaagcagacugaguugucccuggaucuagcacucucuaaauaccugagcgaccuucuguucgucuuuggcccgaacuugcaagaucccguuuccaauucaaugaccauccaggccauuagucaggcuuucggcgggaacuacgaaacacuccugcgaacuuuaggauaugccaccgaggacuuugaugaccugcucgagagcgauucuaucacaggucagauaauuuacguggaccuuuccucauauuacaucaucguacguguguauuucccuauucugaccgaaauccaacaggcauacauucaggaguugcuaccagucagcuuuaacaaugacaacagugaauggauaucuaucgugcccaauuucauucugguuagaaacacgcucaucuccaauaucgagauuggcuuuugccugauaacuaagaggagcgugaucuguaaccaggauuaugcuacaccuaugaccaauaacaugcgggaaugccuuacugggucgacagagaaauguccacgcgagcuggucgugucuucccacguacccagauucgccuugucaaauggaguucucuuugcgaacugcauuagugugaccugucaaugccagacgaccggcagggccaucagccaguccggugaacaaacacuguuaaugauugacaauacuaccuguccuacagcaguccuggggaacgugaucauaucucuaggaaaguaccucggcagcgucaauuacaacucagagggcaucgcuauugggccaccgguguucacugauaagguugacaucaguucccagaaaagcucuaugaaucagucacugcagcaaaguaaggauuauauuaaagaagcccagcggcuuuuggacaccgugaaccccagccugaucuccaugcucucuaugauaauucuguacguacuuucgaucgcuagccugugcauuggauugaucacauuuauauccuucaucauugucgagaagaaacgcaacaccuauucacgacucgaagauagaagggugcggccuacgaguucuggugaccuguacuauaucggcacuuga

SEQ ID NO: 111 - RNA, 1641 nt, Artificial Sequence
  derived and/or modified CDS sequence (opt3) from Nipah henipavirus__AEZ01396__F
auggccgugauccugaacaagagauacuauagcaaucuccuuauucugauauugaugaucuccgagugcucugucggcauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauaccugagcgaucuucuguucguguuuggccccaauuugcaagacccuguguccaacucaaugaccauucaggccaucagucaggcuuucggcgggaacuaugaaacacuccugcgaacuuuaggauacgccaccgaggauuuugacgaucugcucgagagcgacucuauaacaggucagauuaucuaugucgaucuuuccggcuacuauaucauuguucguguguacuucccaauccugaccgaaauucaacaggcauauauacaggaguugcuacccguaucauuuaauaacgacaauagcgaauggaucaguauugugccuaacuucauccuggucagaaauacgcucaucucuaacauugagauaggguuuugucugaucacuaagagguccgugauuugcaaucaggacuacgcuacaccaaugaccaacaauaugcgggaaugucuuacuggaagcacagagaaaugcccccgcgagcugguugugucgucucacgucccuagauucgccuuguccaacggcgugcucuuugcgaauuguaucucaguaaccugccaaugucagacgaccgguagggccauuagucagagcggggaacaaacacuguuaaugaucgauaacacuaccugcccaacagcaguucugggaaaugugauaaucucccuaggcaaguaccucggcucugucaacuauaauagcgaggggauugcuaucggaccgcccguguucacugacaaggucgauauuucaagucagaucuccagcaugaaccagucucugcagcaaucaaaagacuacauaaaggaagcccagcggcuuuuggauaccgugaacccuagucugauuagcaugcucuccaugaucauucuguauguucuuucuaucgcuucgcuguguauagguuugaucacauuuauuagcuucaucauuguggagaaaaagcgcaauaccuacucccgacucgaagacagaaggguacggccaacuucaaguggcgaucuguauuacaucgggacguga

SEQ ID NO: 112 - RNA, 1641 nt, Artificial Sequence
  derived and/or modified CDS sequence (opt3) from Hendra henipavirus__NP_047111__F
auggccacccaggaggugagacugaagugccuccuuuguggcaucauuguccugguuuugagcuuagaagggcugggaauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauugcugggcaaaucguguauguagauuugagcucuuacuauauaauugugcgagucuacuucccaauccuaaccgagauccagcaggccuaugugcaggaacugcuccccguuuccuuuaacaacgacaauucagaguggauuagcaucgugccuaacuucguccugauucguaauacgcuuauaaguaacaucgaagugaaguacugccugauuacuaaaaagucuguaaucuguaaucaagacuaugcgacaccaaugaccgccuccguuagagagugcuugacuggaagcacagauaagugucccagggagcucguggucucgucucacgugccucgguuugcacuguccggcggugucuuauucgcuaacugcaucucagugaccugucagugccagacgaccgggcgcgccauuagucaaagcggagaacagacacugcuaaugauagacaauacuaccuguacaacuguugugcucggcaacaucauuaucucccugggcaaauaccuugggucuauuaauuacaacagcgagucaaucgcuguaggaccaccggucuauaccgauaagguggacauaaguucccagaucagcucuaugaaucagucauugcaacagaguaaagauuacauuaaggaagcccagaaaauccuggacacaguuaaccccagccucauuuccaugcugucuaugaucauacuuuaugugcugucgauugcagccuugugcaucggucucauuaccuuuaucagcuucgucauaguggagaagaagagaggcaauuacuccaggcuggaugaccggcagguacgcccugugucaaacggggauuuauauuacaucggaacuuga

SEQ ID NO: 113 - RNA, 1641 nt, Artificial Sequence
  derived and/or modified CDS sequence (opt3) from Hendra henipavirus__AEB21233__F
auggccacccaggaggugagacugaagugccuccuuuguggcaucauuguccugguuuugagcuuagaagggcugggaauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauuaccgggcaaaucguguauguagauuugagcucuuacuauauaauugugcgagucuacuucccaauccuaacggagauccagcaggcuuaugugcaggaacugcuccccguuuccuuuaacaacgacaauucagaguggauuagcaucgugccuaacuucguccugauucguaauacucuuauaaguaacaucgaagugaaguacugccugauuaccaaaaagucuguaaucuguaaucaagacuaugccacaccaaugacugcguccguuagagagugcuugacaggaagcaccgauaagugucccagggagcucguggucucgucucacgugccucgguuugcccuguccggcggugucuuauucgcaaacugcaucucagugacgugucagugccagaccacagggcgcgcuauuagucaaagcggagaacagacucugcuaaugauagacaauaccacauguacuaccguugugcucggcaacaucauuaucucccugggcaaauaccuugggucuauuaauuacaacagcgagucaaucgccguaggaccaccggucuauacagauaagguggacauaaguucccagaucagcucuaugaaucagucauugcaacagaguaaagauuacauuaaggaagcucagaaaauccuggacaccguuaaccccagccucauuuccaugcugucuaugaucauacuuuaugugcugucgauugccgcauugugcaucggucucauuacuuuuaucagcuucgucauaguggagaagaagagaggcaauuacuccaggcuggaugaccggcagguacgcccugugucaaacggggauuuauauuacaucggaacguga

SEQ ID NO: 114 - RNA, 1641 nt, Artificial Sequence
  derived and/or modified CDS sequence (opt3) from Hendra henipavirus__AEQ38114__F
auggccacccaggaggugagacugaagugccuccuuuguggcaucauuguccugguuuugagcuuagaagggcugggaauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauuaccgggcaaaucguguauguagauuugagcucuuacuauauaauugugcgagucuacuucccaauccuaacggagauccagcaggcuuaugugcaggaacugcuccccguuuccuuuaacaacgacaauucagaguggauuagcaucgugccuaacuucguccugauucguaauacucuuauaaguaacaucgaagugaaguacugccugauuaccaaaaagucuguaaucuguaaucaagacuaugccacaccaaugacugcguccguuagagagugcuugacaggaagcaccgauaagugucccagggagcucguggucucgucucacgugccucgguuugcccuguccggcggugucuuauucgcaaacugcaucucagugacgugucagugccagaccacagggcgcgcuauuagucaaagcggagaacagacucugcuaaugauagacaauaccacauguacuaccguugugcucggcaacaucauuaucucccugggcaaauaccuugggucuauuaauuacaacagcgagucaaucgccguaggaccaccggucuauacagauaagguggacauaaguucccagaucagcucuaugaaucagucauugcaacagaguaaagauuacauuaaggaagcucagaaaauccuggacaccguuaaccccagccucauuuccaugcugucuaugaucauacuuuaugugcugucgauugccgcauugugcaucggucucauuacuuuuaucagcuucauaaucgucgagaagaagagaggcaauuacuccaggcuggaugaccgccaggugcggccuguaucaaacggggauuuauauuacauuggaacguga

SEQ ID NO: 115 - RNA, 1641 nt, Artificial Sequence
  derived and/or modified CDS sequence (opt3) from Hendra henipavirus__AAB39505__F
auggccacccaggaggugagacugaagugccuccuuuguggcaucauuguccugguuuugagcuuagaagggcugggaauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguugauaugcuccuguuucgggcccaaucuccaggauccugucucuaacagcaugacaauccaggcuauuucccaggccuuuggagguaauuacgagacucuguuacgcacccugggcuacgcaacagaggacuucgaugaccuccuugaaucagauaguaucaccgggcaaauaguuuauguggaccugagcucuuacuauauuaucguacgaguguacuuuccaaucuugacggagauucagcaggcuuauguccaggaacuacugcccguguccuucaacaacgauaauucagaguggaucagcauuguuccuaacuuugugcucauacguaauacucugaucaguaacauugaagucaaguacugccuuaucacaaagaagucugugaucuguaaucaagacuaugccaccccaaugacugcguccguaagagagugccugacaggaagcaccgacaagugucccagggaguugguugugucgucucacgucccucgguucgcccucuccggcggugugcuguuugcaaacugcauuucagucacgugucagugccagaccacagggcgcgcuauaagucaaagcagagaacagacuuuacugaugaucgauaauaccacaugcacuaccgugguucuaggaaacauuaucauuucccucccaaaauaccugggcucuaucaaacuucagguguugagggcccugcuccugggccaucagagcauacaaacaaaaguagacaucucaagucagauuuccagcaugaaucagucucuucagcaaucaaaggauuacaucaaagaggcucagaagauucuggacaccgucaacccgaguuugaucagcaugcucuccaugauaauucuguauguguuaucuaucgccgcacuguguauugggcuaaucacuuucauaucguuuguuaucguggaaaagaaacggggaaauuacagccgccucgaugaccgacaggucagacccguguccaacggugaucuguauuacauuggcacguga

SEQ ID NO: 116 - RNA, 1809 nt, Artificial Sequence
  derived and/or modified CDS sequence (opt3) from Nipah henipavirus__AAK50554__G
augcccgccgagaacaagaaagugagauucgaaaauaccacaagcgacaagggcaaaaucccuuccaaggucauuaaaucuuacuaugggacuauggauauaaagaagaucaacgagggacugcucgacucaaaaauucuuagugcuuuuaauacgguuaucgcacuguuggguagcauugugaucauaguaaugaacaucaugauuauccagaauuacaccagguccacagauaaccaagccgugauuaaggacgcguuacagggcauccagcagcaaauaaaagggcuggcugauaagauuggaacugaaaucggcccaaaagucucucuaauugacaccucgucaacaaucaccaucccggccaauauuggucuccuggggagcaagauaagucaguccacugcaucuaucaacgagaaugugaacgaaaagugcaaauucacacuucccccucugaagauucacgaguguaauaucagcugcccaaaccccuugccuuuucgggaguaucgcccacagaccgaaggaguuuccaaucucgugggccugcccaacaauauaugucugcagaaaacgucaaaccaaauucucaagccuaaauuaaucaguuacacucugccagucgugggccagagcgggaccugcaucacagauccgcuuuuggccauggacgagggauauuucgcuuacucucaucuggaacgaauugguuccuguucacguggcguaagcaagcagagaaucauugggguuggagaggugcuagauaggggcgacgagguccccagucucuuuaugacuaacguguggaccccuccaaaucccaacacaguguaucacugcucugcagucuacaauaacgaguucuacuauguucugugugccguguccaccguaggugauccuauacuuaauagcacguacuggucggggucucugaugaugacucgguuggcugugaaaccaaaguccaacggaggcggcuauaaucagcaucaacucgcccugcgcucaaucgaaaaggggagauacgacaaagucaugcccuauggaccgagugguauuaagcagggcgauacauuauacuuuccugcggugggguuccugguuaggaccgaauuuaaauauaacgacagcaauugccccaucacuaagugucaguacuccaaaccagagaacugccggcucucuaugggaauccgcccuaauagccacuacauucuucgaucaggccuguugaaguauaaccuaagugacggugaaaaucccaagguggucuucauagagaucuccgaucaaagacugagcauugggucuccaucaaaaaucuacgacagucucggccagcccguguuuuaucaggccagcuucuccugggauacaaugauuaaguuuggagacguacugaccguuaacccucuuguggucaauuggaggaacaacacggugaucucucggccaggccagucgcaauguccgcguuucaauaccugccccgagauaugcugggaaggggucuacaacgaugcauuccugaucgaccgcauuaauuggaucagcgcuggaguguuuuuggauuccaaccagacagccgagaauccuguuuucacuguguuuaaagacaacgaaauucucuauagagcacagcuggcuucagaggauaccaaugcccagaagacaaucacuaacuguuucuuacugaaaaauaagauauggugcauuagucuaguagaaaucuacgacaccggugauaacgucauuaggccaaagcucuuugcggugaaaauccccgagcaauguacauga

SEQ ID NO: 117 - RNA, 1809 nt, Artificial Sequence
  derived and/or modified CDS sequence (opt3) from Nipah henipavirus__AEZ01389__G
augcccaccgagagcaagaaagugagauucgaaaacacagccuccgacaagggcaaaaauccuucuaaggucaucaaaucauacuaugggacuauggauauuaagaagauaaacgagggacugcucgacaguaaaauccuuagcgcuuuuaauacgguuauugcacuguuggguuccaucgugauuaucguaaugaacauaaugaucauucagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccauucuuaauuccaccuacuggucagguagucugaugaugacgagauuggcugugaagccuaaaaacaauggggaaagcuauaaccagcaucaauuugcccucaggaauauagaaaagggaaaauacgacaaggucaugccauauggccccuccggcaucaaacagggggauacucuguacuucccggcggugggauuuuuaguucggacagaguucaaguauaacgacucuaauugcccuauugcagaaugucaguacagcaagcccgagaacugccgccugucaauggguaucagaccaaauagucacuacauccucagguccggccuucugaaauauaacuugagcgacgaggaaaauucuaagauuguguuuauagagaucucagaucaacggcuaaguauugggagcccuuccaaaaucuacgacucucugggacagcccgucuucuaucaggccucguuuagcugggauaccaugauuaaguucggcgacgugcagacuguaaacccacucguugugaacuggcgcgauaauacagucaucucccgacccggucaaucacaguguccuagauucaacaaaugcccagaagugugcugggagggggucuacaaugacgcuuuucugauagauaggaucaacuggauuagugccggcguguuccuugacucuaaucagaccgcagaaaacccgguuuuuacgguguucaaggauaaugagguacuguaucgggcucaguuggccagcgaggacaccaacgcgcaaaagacaaucacuaauuguuuucuccugaaaaacaagauuuggugcaucuccuuagucgaaauauacgauaccggagacaaugugauucgucccaaacuguucgccguuaagaucccugagcaguguacauga

SEQ ID NO: 118 - RNA, 1809 nt, Artificial Sequence
  derived and/or modified CDS sequence (opt3) from Nipah henipavirus__ACT32615__G
augcccaccgagagcaagaaagugagauucgaaaacacagccuccgacaagggcaaaaauccuucuaaggucaucaaaucauacuaugggacuauggauauuaagaagauaaacgagggacugcucgacaguaaaauccuuagcgcuuuuaauacgguuauugcacuguuggguuccaucgugauuaucguaaugaacauaaugaucauucagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccgugcuuaauuccaccuacuggucagguagucugaugaugacgagauuggcugucaagccuaaaaacaauggggaaagcuauaaccagcaucaauuugcccucaggaauauugaaaagggaaaauacgacaaggugaugccauauggccccuccggcauaaaacagggggauacucuguacuucccggcgguuggauuuuuagugcggacagaguucaaguauaacgacucuaauugcccuaucgcagaaugucaguacagcaagcccgagaacugccgccugucaauggguauuagaccaaauagucacuacauccucagguccggccuucugaaauauaacuugagcgacgaggaaaauucuaagaucgucuuuauugagauaucagaucaacggcuaaguaucgggagcccuuccaaaauuuacgacucucugggacagcccguguucuaucaggccucguuuagcugggauaccaugaucaaguucggcgacguacagacuguuaacccacucguggucaacuggcgcgauaauacagugauuucccgacccggucaaucacaguguccuagauucaacaaaugcccagaagucugcugggaggggguguacaaugacgcuuuucugaucgauaggauaaacuggaucagugccggcguuuuccuugacucuaaucagaccgcagaaaacccgguguuuacgguauucaaggauaaugagguccuguaucgggcucaguuggccagcgaggacaccaacgcgcaaaagacaauuacuaauuguuuucuccugaaaaacaagaucuggugcauuuccuuaguggaaaucuacgauaccggagacaauguuauacgucccaaacuguucgccgugaagauuccugagcaguguacauga

SEQ ID NO: 119 - RNA, 1809 nt, Artificial Sequence
  derived and/or modified CDS sequence (opt3) from Nipah henipavirus__CAF25497__G
augcccgccgagaacaagaaagugagauucgaaaauaccacaagcgacaagggcaaaaacccuuccaaggucaucaaaucuuacuaugggacuauggauauuaagaagauaaaugagggacugcucgacucaaaaauccuuagugcuuuuaacacgguuauugcacuguuggguagcaucgugauuaucguaaugaauauaaugaucauucagaacuacaccagguccacagauaaucaagccgugaucaaggacgcguuacagggcauucagcagcaaaucaaagggcuggcugauaagauaggaacugaaauuggcccaaaagucucucuaaucgacaccucgucaacaauuaccaucccggccaacaucggucuccuggggagcaagauuagucaguccacugcaucuauaaaugagaacgugaaugaaaagugcaaauucacacuucccccucugaagauccacgaguguaacauuagcugcccaaaucccuugccuuuucgggaguaucgcccacagaccgaaggaguuuccaaccucgugggccugcccaauaacaucugucugcagaaaacgucaaaccaaauacucaagccuaaauuaauuaguuacacucugccagucgugggccagagcgggaccugcaucacagauccgcuuuuggccauggacgagggauauuucgcuuacucucaucuggaacgaaucgguuccuguucacguggcguaagcaagcagagaauuaucgggguuggagaggugcuagauaggggcgacgagguccccagucucuuuaugacuaaugugugggcaccuccaaaccccaauaccguguaucacugcucugccgucuacaacaaugaguucuacuauguucugugugcuguguccacaguaggugauccuauucuuaacagcaccuacuggucggggucucugaugaugacgcgguuggccgugaaaccaaaguccaauggaggcggcuauaaccagcaucaacucgcgcugcgcucaauagaaaaggggagauacgacaaagucaugcccuauggaccgagugguaucaagcagggcgauacuuuauacuuuccugcagugggguuccugguuaggacagaauuuaaauauaaugacagcaacugccccauuaccaagugucaguacuccaaaccagagaauugccggcucucuaugggaauccgcccuaacagccacuacauccuucgaucaggccuguugaaguauaaucuaagugacggugaaaaccccaagguggucuucauugagauauccgaucaaagacugagcaucgggucuccaucaaaaauuuacgacagucucggccagcccguguuuuaucaggccagcuucuccugggauacuaugaucaaguuuggagacguacugacaguuaauccucuuguggucaacuggaggaacaauaccgugauuucucggccaggccagucgcaauguccgcguuucaacacgugccccgagaucugcugggaaggggucuacaaugaugcuuuccugauagaccgcaucaacuggauuagcgccggaguguuuuuggauuccaaucagaccgcagagaacccuguuuucacaguguuuaaagacaaugaaauccucuauagagcucagcuggccucagaggauacuaacgcgcagaagaccauuacaaauuguuucuuacugaaaaacaagaucuggugcauaagucuaguagaaauuuacgacacuggugauaaugucaucaggccaaagcucuuugccgugaaaauucccgagcaauguaccuga

SEQ ID NO: 120 - RNA, 1809 nt, Artificial Sequence
  derived and/or modified CDS sequence (opt3) from Nipah henipavirus__CBM41034__G
augcccgccgagaacaagaaagugagauucgaaaauaccacaagcgacaagggcaaaaacccuuccaaggucaucaaaucuuacuaugggacuauggauauuaagaagauaaaugagggacugcucgacucaaaaauccuuagugcuuuuaacacgguuauugcacuguuggguagcaucgugauuaucguaaugaauauaaugaucauucagaacuacaccagguccacagauaaucaagccgugaucaaggacgcguuacagggcauucagcagcaaaucaaagggcuggcugauaagauaggaacugaaauuggcccaaaagucucucuaaucgacaccucgucaacaauuaccaucccggccaacaucggucuccuggggagcaagauuagucaguccacugcaucuauaaaugagaacgugaaugaaaagugcaaauucacacuucccccucugaagauccacgaguguaacauuagcugcccaaaucccuugccuuuucgggaguaucgcccacagaccgaaggaguuuccaaccucgugggccugcccgauaauaucugucugcagaaaacgucaaaccaaauacucaagccuaaauuaauuaguuacacucugccagucgugggccagagcgggaccugcaucacagacccgcuuuuggccauggaugagggauauuucgcuuacucucaucuggaacgaaucgguuccuguucacguggcguaagcaagcagagaauuaucgggguuggagaggugcuagacaggggcgaugagguccccagucucuuuaugacuaacguguggaccccuccaaaucccaacacaguguaucacugcucugcagucuacaauaacgaguucuacuauguucugugugccguguccaccguaggugacccuauucuuaauagcacguacuggucggggucucugaugaugacucgguuggcugugaaaccaaaguccaacggaggcggcuauaaucagcaucaacucgcccugcgcucaauagaaaaggggagauacgauaaagucaugcccuauggaccgagugguaucaagcagggcgacacauuauacuuuccugcggugggguuccugguuaggaccgaauuuaaauauaacgacagcaauugccccauuacuaagugucaguacuccaaaccagagaacugccggcucucuaugggaauccgcccuaauagccacuacauccuucgaucaggccuguugaaguauaaccuaagugauggugaaaaucccaagauuguguucauagagaucuccgaccaaagacugagcauugggucuccaucaaaagucuacgauagucucggccagcccguguuuuaucaggccagcuucuccugggacacaaugaucaaguuuggagauguacagaccguuaacccucugguggucaauuggagggacaacacggugauuucucggccaggccaaucgcaguguccgcguuucaauaccugccccgagaucugcugggaaggggucuacaacgaugcauuccuuauagaccgcaucaacuggauuagcgcuggaguguuucuggauuccaaucagacagccgagaacccuguuuucacuguguuuaaagacaaugaaaucuuguauagagcacagcucgcuucagaggauaccaacgcccaaaagacaauuacuaauuguuuccugcugaaaaacaagaucuggugcauaaguuuaguagaaauuuacgacaccggugacaaugucaucaggccaaagcuauuugcggugaaaauucccgagcaguguacauga

SEQ ID NO: 121 - RNA, 1809 nt, Artificial Sequence
  derived and/or modified CDS sequence (opt3) from Nipah henipavirus__AAX51853__G
augcccgccgagagcaagaaagugagauucgaaaacaccacauccgacaagggcaaaaucccuucuaagauuauaaaaucauacuaugggacuauggauaucaagaagauuaaugagggacugcucgacaguaaaauccuuagcgcuuuuaacacggucauugcacuguuggguuccaucguuauaaucgugaugaauauuaugaucauucagaacuacaccaggucuacagauaaucaagccguaaucaaggacgcguuacagggcauacagcagcaaauuaaagggcuggcugauaagaucggaacugaaauuggcccaaaagugucgcuaaucgacaccucaagcacaaucaccauuccggccaacauaggucuccuggggaguaagaucucccagucuacugcaagcauuaaugagaacgucaaugaaaagugcaaauucacacuucccccucugaagauccacgaguguaacauauccugcccaaaucccuugccuuuucgggaguaucgcccacagaccgaaggagugucaaaccucguuggccugcccaauaacauuugucugcagaaaacgaguaaucaaauccucaagccuaaauuaaucagcuacacucugccaguggucggccagucugggaccugcauuacagauccgcuuuuggccauggacgagggauauuucgcuuacucccaucuggaacgaaucgguucauguagccguggcgugaguaagcagaaaauuauagggguaggagagguucuagauagaggcgacgaggugcccucucucuuuaugacuaacgucuggaccccuccaaaccccaauacaguguaucacugcuccgcaguguacaacaaugaguucuacuauguccugugugccguuagcaccgugggugauccuauccuuaacucgacguacuggucugggucccugaugaugacuagguuggcuguaaagccaaagucaaaugacggaggcuauaaccagcaucaacucgcccugcggaguauugaaaaaggccgcuacgauaaggugaugcccuaugggccgagcggaaucaaacagggugacacauuauacuuuccugcggucggcuuccuggugagaaccgaauuuaaguauaaugacuccaacugccccaucacuaaaugucaguacucuaagccagagaauugcaggcucagcauggggauucggccuaacucacacuacguucuucgcaguggacuguugaaguauaaucuauccgauggcgaaaaccccaaaauaguguucaucgagauuagcgaccaacgacugucuaucgguucaccaaguaagauuuacgauagccucgggcagcccgucuuuuaucaggcauccuucucuugggacacaaugaucaaauuuggcgaugugcagaccguaaauccucugguugugucguggagagacaacacggucauaagcaggccaggacaaucccaguguccgcgguucaauaccugccccgagaucugcugggaaggcguguacaacgaugccuuccuuauugaccguaucaacuggauuucagcuggggucuuucuggauaguaaucagacagccgagaacccuguguucacuguuuuuaaggacaaugaaaucuuguaucgcgcacagcucgcuucugaggauaccaacgcccagaaaacaauaacuaauuguuuccuguuaaagaacaagauuuggugcaucagccugguggaaauuuacgacaccggagacaauguaaucagaccaaaacuauuugcggucaagauacccgagcaauguacauga

SEQ ID NO: 122 - RNA, 1809 nt, Artificial Sequence
  derived and/or modified CDS sequence (opt3) from Nipah henipavirus__AEZ01397__G
augcccaccgagagcaagaaagugagauucgaaaacacagccuccgacaagggcaaaaauccuucuaaggucaucaaaucauacuaugggacuauggauauuaagaagauaaacgagggacugcucgacaguaaaauccuuagcgcuuuuaauacgguuauugcacuguuggguuccaucgugauuaucguaaugaacauaaugaucauucagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccauucuuaauuccaccuacuggucagguagucugaugaugacgagauuggcugugaagccuaaaaacaauggggaaagcuauaaccagcaucaauuugcccucaggaauauagaaaagggaaaauacgacaaggucaugccauauggccccuccggcaucaaacagggggauacucuguacuucccggcggugggauuuuuaguucggacagaguucaccuauaacgacucuaauugcccuauugcagaaugucaguacagcaagcccgagaacugccgccugucaauggguaucagaccaaauagucacuacauccucagguccggccuucugaaguauaacuugagcgacgaggaaaauucuaaaauuguguuuauagagaucucagaucaacggcuaaguauugggagcccuuccaagaucuacgacucucugggacagcccgucuucuaucaggccucguuuagcugggauacuaugauuaaauucggcgacgugcagacaguaaacccacucguugugaacuggcgcgauaauaccgucaucucccgacccggucaaucacaguguccuagauucaacaagugcccagaagugugcugggagggggucuacaaugacgcuuuucugauagauaggaucaacuggauuagugccggcguguuccuugacucuaaucagacggcagaaaacccgguuuuuaccguguucaaagauaaugagguacuguaucgggcucaguuggccagcgaggacacaaacgcgcaaaagacuaucaccaauuguuuucuccugaagaacaaaauuuggugcaucuccuuagucgaaauauacgauacaggagacaaugugauucgucccaagcuguucgccguuaaaaucccugagcaguguacuuga

SEQ ID NO: 123 - RNA, 1815 nt, Artificial Sequence
  derived and/or modified CDS sequence (opt3) from Hendra henipavirus__NP_047112__G
augauggccgacagcaagcuggugucccucaacaauaaccuuucuggcaaaaucaaggaucaggggaaagucauuaagaauuacuauggaaccauggacaucaaaaagauaaacgauggucuguuggacucaaagauuuuaggcgcuuucaauacaguuaucgcacugcuagggaguauuaucauaaucgugaugaacauuaugaucauucaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauagccaucacaaaggucgaaagagggaaauacgauaagguuaugccuuauggaccauccggcauuaaacaaggcgacacccucuacuuucccgcugugggguuccuuccgaggacggaguuucaguauaaugauucuaacugcccuaucauucacuguaaguacagcaaagccgagaauugccggcugucaaugggaguaaacaguaagucccacuauaucuugcgcagcggucuacugaaguacaaucucucucugggcggggacauaauccuucaguucauugaaaucgcggauaaccgacugaccauuggaucacccaguaaaaucuacaauagcuugggccaaccaguguuuuaucaggcauccuacucuugggacacaaugauaaagcucggugaugucgacacuguggauccucugagaguucaguggaggaacaauucggugauuagccggcccgggcagucccaauguccacguuucaacgucugccccgaggugugcugggaaggcaccuauaaugacgccuuuuuaaucgaccgccugaacuggguaucagcuggaguuuaccuaaacaguaaucagacagccgagaacccuguguucgcagucuucaaagauaaugaaauucucuaucaggugccacuggcugaggacgauacuaacgcccagaagaccaucacagacuguuuucuuuuggagaaugucauauggugcaucucucugguggaaauuuacgauaccggcgacagcguuaucagaccgaaacucuucgcggugaagauucccgcccaauguuccgagucauga

SEQ ID NO: 124 - RNA, 1815 nt, Artificial Sequence
  derived and/or modified CDS sequence (opt3) from Hendra henipavirus__AEB21225__G
augauggccgacagcaagcuggugucccucaacaauaaccuuucuggcaaaaucaaggaucaggggaaagucauuaagaauuacuauggaaccauggacaucaaaaagauaaacgauggucuguuggacucaaagauuuuaggcgcuuucaauacaguuaucgcacugcuagggaguauuaucauaaucgugaugaacauuaugaucauucaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauagccaucacaaaggucgaaagagggaaauacgauaagguuaugccuuauggaccauccggcauuaaacaaggcgacacccucuacuuucccgcugugggguuccuuccgaggacggaguuucaguauaaugauucuaacugcccuaucauucacuguaaguacagcaaagccgagaauugccggcugucaaugggaguaaacaguaagucccacuauaucuugcgcagcggucuacugaaguacaaucucucucugggcggggacauaacccuucaguucaucgaaauugcggauaaccgacugacaaucggaucacccaguaaaauuuacaauagcuugggccaaccaguguuuuaucaggcauccuacucuugggacacuaugaucaagcucggugaugucgacaccguggauccucugagaguucaguggaggaacaauucggugauaagccggcccgggcagucccaauguccacguuucaacgucugccccgaggugugcugggaaggcacauauaaugacgccuuuuuaauugaccgccugaacuggguaucagcuggaguuuaccuaaacaguaaucagacugccgagaacccuguguucgcagucuucaaagauaaugaaauccucuaucaggugccacuggcugaggacgauaccaacgcccagaagacaauuaccgacuguuuucuuuuggagaaugucaucuggugcauaucucugguggaaaucuacgauacuggcgacagcguuauuagaccgaaacucuucgcggugaagauccccgcccaauguuccgagucauga

SEQ ID NO: 125 - RNA, 1815 nt, Artificial Sequence
  derived and/or modified CDS sequence (opt3) from Hendra henipavirus__AEB21216__G
augauggccgacagcaagcuggugucccccaacaauaaccucucuggcaaaaucaaggaucaggggaaagucauuaagaauuacuauggaaccauggacaucaaaaagauaaacgauggucuucuggacucaaagauuuugggcgcuuucaauacaguuaucgcauuacuggggaguauuaucauaaucgugaugaacauuaugaucauucaaaauuacacuagaacgaccgauaaccaggcccuaaucaaagagagccuccaguccguacagcaacagauaaaggcgcugacagacaaaauuggaacugaaaucggcccuaaggugucucuuauugauaccucgucaacaaucaccaucccagcuaauauuggucuguuggggagcaaaauaagucaguccacuucuagcaucaacgagaaugucaacgacaagugcaaguuuacacucccgccccugaaaauucacgaauguaauaucuccugcccuaacccacugcccuucagggaguaucggccuauaucacagggagugagugaucucguuggcuuaccaaaucaaauuugucugcagaagaccacgagcacuauccuuaaaccccgcuugaucucuuacacccugccuauuaacacacgagaaggcgugugcaucacugacccacuacucgccgucgauaacggguuuuucgcauauucccaucuggagaagauuggaucauguacccgugguauagccaaacagagaaucauuggcgugggggagguacuugacaggggagauaagguuccgagcauguuuaugacaaauguguggacgcccccuaacccaaguaccauccaccauuguucuuccacuuaccacgaagacuucuauuacacacugugcgcugucagccaugugggcgaccccauccucaauucgaccucuuggacugaguccuugucacugauucgguuagcagugcgcccuaaaagugauagcggugacuacaaccagaaguauauagccaucaauaaggucgaaagagggaaauacgauaagguuaugccauauggacccuccggcauuaaacaaggcgacacacuguacuuuccggcugugggguuccucccuaggaccgaguuucaguauaacgauucuaauugccccaucauucacuguaaguacagcaaagccgagaacugccggcuuucaaugggaguaaauaguaagucccacuauauccugcgcagcgguuugcuaaaguacaaccugucucucggcggggacauaauccugcaguucauugaaaucgcggauaaucgacuuacgauuggaucaccaaguaaaaucuacaacagccugggccaaccuguguuuuaucaggcauccuacucuugggacaccaugauaaaguugggugaugucgacacaguggauccccucagaguucaguggaggaauaacucggugauuagccggccagggcagucccaauguccccguuucaaugucugcccugaggugugcugggaaggcacuuauaacgacgccuuucugaucgaccgcuuaaacuggguaucagcuggaguuuaccugaauaguaaccagaccgccgagaauccaguguucgcagucuucaaagauaacgaaauucuauaucaggugccgcucgcugaggacgauacaaaugcccagaagacuaucaccgacuguuuucugcuugagaacgucauauggugcaucucuuugguggaaauuuacgauacaggcgacagcguuaucagacccaaacuguucgcggugaagauuccugcccaauguuccgagucauga

SEQ ID NO: 126 - RNA, 1815 nt, Artificial Sequence
  derived and/or modified CDS sequence (opt3) from Hendra henipavirus__AEB21206__G
augauggccgacagcaagcuggugucccucaacaauaaccuuucuggcaaaaucaaggaucaggggaaagucauuaagaauuacuauggaaccauggacaucaaaaagauaaacgauggucuguuggacucaaagauuuuaggcgcuuucaauacaguuaucgcacugcuagggaguauuaucauaaucgugaugaacauuaugaucauucaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcgguaacuacaaucagaaguauauagccaucacaaaggucgaaagagggaaauacgacaagguuaugccuuauggaccauccggcauuaaacaaggcgauacccucuacuuucccgcugugggguuccuuccgaggacggaguuucaguauaacgacucuaauugcccuaucauucacuguaaguacagcaaagccgagaacugccggcugucaaugggaguaaauaguaagucccacuauaucuugcgcagcggucuacugaaguacaaccucucucugggcggggauauaauccuucaguucauugaaaucgcggacaaucgacugaccauuggaucacccaguaaaaucuacaacagcuugggccaaccaguguuuuaucaggcauccuacucuugggauacaaugauaaagcucggugacauugauacugucgacccucugagagugcaguggaggaauaacucgguuaucagccggcccgggcagucccaauguccacguuucaaugugugccccgaggucugcugggaaggcaccuauaacgaugccuuuuuaauugaccgccugaacugggugucagcuggaguauaccuaaauaguaaccagacagccgagaauccuguuuucgcaguguucaaagacaacgaaauccucuaucaggucccacuggcugaggaugacacuaaugcccagaagaccauaacagauuguuuucuuuuggagaacgugaucuggugcauuucucuggucgaaaucuacgacaccggcgauagcgugauuagaccgaaacucuucgcgguuaagauccccgcccaauguuccgagucauga

SEQ ID NO: 127 - RNA, 1815 nt, Artificial Sequence
  derived and/or modified CDS sequence (opt3) from Hendra henipavirus__AEQ38052__G
augauggccgacagcaagcuggugucccucaacaauaaccuuucuggcaaaaucaaggaucaggggaaagucauuaagaauuacuauggaaccauggacaucaaaaagauaaacgauggucuguuggacucaaagauuuuaggcgcuuucaauacaguuaucgcacugcuagggaguauuaucauaaucgugaugaacauuaugaucauucaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauaacaaucaccaaggucgaaagagggaaauacgauaagguuaugccuuauggaccauccggcauuaaacaaggcgacacgcucuacuuucccgccgugggguuccuuccgaggaccgaguuucaguauaaugauucuaacugcccuaucauucacuguaaguacagcaaagcugagaauugccggcugucaaugggaguaaacaguaagucccacuauaucuugcgcagcggucuacugaaguacaaucucucucugggcggggacauaauccuucaguucauugaaaucgccgauaaccgacugacaauuggaucacccaguaaaaucuacaauagcuugggccaaccaguguuuuaucaggcguccuacucuugggacacuaugauaaagcucggugaugucgacaccguggauccucugagaguucaguggaggaacaauucggugauuagccggcccgggcagucccaauguccacguuucaacgucugccccgaggugugcugggaaggcacauauaaugacgcauuuuuaaucgaccgccugaacuggguaucagccggaguuuaccuaaacaguaaucagacugcugagaacccuguguucgccgucuucaaagauaaugaaauucucuaucaggugccacuggcagaggacgauaccaacgcucagaagacaaucaccgacuguuuucuuuuggagaaugucauauggugcaucucucugguggaaauuuacgauacuggcgacagcguuaucagaccgaaacucuucgccgugaagauucccgcgcaauguuccgagucauga

SEQ ID NO: 128 - RNA, 1815 nt, Artificial Sequence
  derived and/or modified CDS sequence (opt3) from Hendra henipavirus__AEQ38115__G
augauggccgacagcaagcuggugucccucaacaauaaccuuucuggcaaaaucaaggaucaggggaaagucauuaagaauuacuauggaaccauggacaucaaaaagauaaacgauggucuguuggacucaaagauuuuaggcgcuuucaauacaguuaucgcacugcuagggaguauuaucauaaucgugaugaacauuaugaucauucaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauaacggugacuacaaucagaaguauauagccaucacaaaggucgaaagagggaaauacgauaagguuaugccuuauggaccaagcggcauuaaacaaggcgacacccucuacuuucccgcugugggguuccuuccgaggacggaguuucaguauaacgauuccaauugcccuaucauucacuguaaguacucuaaagccgagaacugccggcugagcaugggaguaaauucaaagagucacuauaucuugcgcuccggucuacugaaguacaaccucagccugggcggggacauaauccuucaguucauugaaaucgcggauaaucgacugaccauuggaucucccucaaaaaucuacaacaguuugggccaaccaguguuuuaucaggcaagcuacuccugggacacaaugauaaagcucggugaugucgacacuguggauccucugagaguucaguggaggaauaacucugugauuucgcggcccgggcagagccaauguccacguuucaaugucugccccgaggugugcugggaaggcaccuauaacgacgccuuuuuaaucgaccgccugaacuggguauccgcuggaguuuaccuaaauucaaaccagacagccgagaauccuguguucgcagucuucaaagauaacgaaauucucuaucaggugccacuggcugaggacgauacuaaugcccagaagaccaucacagacuguuuucuuuuggagaacgucauauggugcaucagucugguggaaauuuacgauaccggcgacucuguuaucagaccgaaacucuucgcggugaagauucccgcccaauguagcgaguccuga

SEQ ID NO: 129 - RNA, 1815 nt, Artificial Sequence
  derived and/or modified CDS sequence (opt3) from Hendra henipavirus__AEQ38108__G
augauggccgacagcaagcuggugucccucaacaauaaccuuucuggcaaaaucaaggaucaggggaaagucauuaagaauuacuauggaaccauggacaucaaaaagauaaacgauggucuguuggacucaaagauuuuaggcgcuuucaauacaguuaucgcacugcuagggaguauuaucauaaucgugaugaacauuaugaucauucaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauaacaaucaccaaggucgaaagagggaaauacgauaagguuaugccuuauggaccauccggcauuaaacaaggcaauacgcucuacuuucccgccgugggguuccuuccgaggaccgaguuucaguauaacgacucuaauugcccuaucauucacuguaaguacagcaaagcugagaacugccggcugucaaugggaguaaauaguaagucccacuauaucuugcgcagcggucuacugaaguacaaccucucucugggcggggauauaauccuucaguucauugaaaucgccgacaaucgacugacaauuggaucacccaguaaaaucuacaacagcuugggccaaccaguguuuuaucaggcguccuacucuugggauacuaugauaaagcucggugacgucgauaccguggacccucugagaguucaguggaggaauaacucggugauuagccggcccgggcagucccaauguccacguuucaaugucugccccgaggugugcugggaaggcacauauaacgaugcauuuuuaaucgaccgccugaacuggguaucagccggaguuuaccuaaauaguaaccagacugcugagaauccuguguucgccgucuucaaagacaacgaaauucucuaucaggugccacuggcagaggaugacaccaaugcucagaagacaaucaccgauuguuuucuuuuggagaacgucauauggugcaucucucugguggaaauuuacgacacuggcgauagcguuaucagaccgaaacucuucgccgugaagauucccgcgcaauguuccgagucauga

SEQ ID NO: 130 - RNA, 1815 nt, Artificial Sequence
  derived and/or modified CDS sequence (opt3) from Hendra henipavirus__AAV80426__G
augauggccgacagcaagcuggugucccucaacaauaaccuuucuggcaaaaucaaggaucaggggaaagucauuaagaauuacuauggaaccauggacaucaaaaagauaaacgauggucuguuggacucaaagauuuuaggcgcuuucaauacaguuaucgcacugcuagggaguauuaucauaaucgugaugaacauuaugaucauucaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucagugcacuuccucuaucaacgagaaugucaacgacaaguguaaguuuacacugccaccgcugaaaauucacgaaugcaauaucagcugucccaacccucucccauucagggaguaucggcccauaucccagggagugucagauuuaguuggccugccuaaucaaauuugccuucagaagaccacgaguacuaucuugaaaccacgccugaucagcuacacccuacccauuaacacacgagaaggcguguguaucacugacccucuccuggccgucgauaacggguuuuucgcauauucucaucuugagaagauuggauccugcacccgugguauagccaaacagagaaucauuggcgugggggagguacuggacaggggagauaagguuccaucaauguuuaugacaaauguguggaccccgcccaacccuagcacgauccaccauuguaguucuacuuaccacgaagacuucuauuacacauugugcgcugucucccaugugggcgacccaauccucaauagcaccucguggacugagucucuguccuuaauucggcuggcagugcgccccaaaucagauaguggugacuacaaccagaaguauauagccaucacaaaggucgaaagagggaaauacgauaagguuaugccuuauggaccaagcggcauuaaacaaggcgacacccucuacuuucccgcugugggguuccuuccgaggacggaguuucaguauaaugauuccaacuguccuaucauucacugcaaguacucuaaagccgagaauugucggcugagcaugggaguaaacucaaagagucacuauaucuugcgcuccggucuacugaaguacaaucucagccugggcggggacauaauccuucaguucauugaaaucgcggauaaccgacugaccauuggaucucccucaaaaaucuacaauaguuugggccaaccaguguuuuaucaggcaagcuacuccugggacacaaugauaaagcucggugaugucgacacuguggauccucugagaguucaguggaggaacaauucugugauuucgcggcccgggcagagccaaugcccacguuucaacgucugccccgagguguguugggaaggcuccuauaaugacgccuuuuuaaucgaccgccugaacuggguaucagcuggaguuuaccuaaacaguaaucagaccgccgagaacccuguguucgcagucuucaaagauaaugaaauucucuaucaggugccacuggcugaggacgauacaaacgcccagaagacuaucaccgacugcuuucuuuuggagaaugucauaugguguaucucucugguggaaauuuacgauacaggcgacagcguuaucagaccgaaacucuucgcggugaagauucccgcccaaugcuccgagucauga

SEQ ID NO: 131 - RNA, 1641 nt, Artificial Sequence
  derived and/or modified CDS sequence (opt4) from Nipah henipavirus__AAK50553__F
augguggugauccuggacaagagaugcuacugcaaccugcugauccugauccugaugaucagcgagugcagcgugggcauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 132 - RNA, 1641 nt, Artificial Sequence
  derived and/or modified CDS sequence (opt4) from Nipah henipavirus__AEZ01388__F
auggccgugauccugaacaagagauacuacagcaaccugcugauccugauccugaucaucagcgagugcagcgugggcauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 133 - RNA, 1641 nt, Artificial Sequence
  derived and/or modified CDS sequence (opt4) from Nipah henipavirus__AAY43915__F
auggccgugauccugaacaagagauacuacagcaaccugcugauccugauccugaugaucagcgagugcagcgugggcauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguacagcagcgaccugcuguucguguucggccccaaccugcaggaccccgugagcaacagcaugaccauccaggccaucagccaggccuucggcggcaacuacgagacccugcugagaacccugggcuacgccaccgagggcuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 134 - RNA, 1641 nt, Artificial Sequence
  derived and/or modified CDS sequence (opt4) from Nipah henipavirus__CAF25496__F
augguggugauccuggacaagagaugcuacugcaaccugcugauccugauccugaugaucagcgagugcagcgugggcauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaucgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 135 - RNA, 1641 nt, Artificial Sequence
  derived and/or modified CDS sequence (opt4) from Nipah henipavirus__AAM13405__F
augguggugauccuggacaagagaugcuacugcaaccugcugauccugauccugaugaucagcgagugcagcgugggcauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaccaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 136 - RNA, 1641 nt, Artificial Sequence
  derived and/or modified CDS sequence (opt4) from Nipah henipavirus__CBM41033__F
augguggugauccuggacaagagaugcuacagcaaccugcugauccugauccugaugaucagcgagugcagcgugggcauccugcacuacgagaagcugagcaagaucggccuggugaagggcgugaccagaaaguacaagaucaagagcaacccccugaccaaggacaucgugaucaagaugaucgccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaagagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 137 - RNA, 1641 nt, Artificial Sequence
  derived and/or modified CDS sequence (opt4) from Nipah henipavirus__AEZ01396__F
auggccgugauccugaacaagagauacuacagcaaccugcugauccugauccugaugaucagcgagugcagcgugggcauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 138 - RNA, 1641 nt, Artificial Sequence
  derived and/or modified CDS sequence (opt4) from Hendra henipavirus__NP_047111__F
auggccacccaggaggugagacugaagugccugcugugcggcaucaucgugcuggugcugagccuggagggccugggcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucgccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 139 - RNA, 1641 nt, Artificial Sequence
  derived and/or modified CDS sequence (opt4) from Hendra henipavirus__AEB21233__F
auggccacccaggaggugagacugaagugccugcugugcggcaucaucgugcuggugcugagccuggagggccugggcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 140 - RNA, 1641 nt, Artificial Sequence
  derived and/or modified CDS sequence (opt4) from Hendra henipavirus__AEQ38114__F
auggccacccaggaggugagacugaagugccugcugugcggcaucaucgugcuggugcugagccuggagggccugggcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucaucaucguggagaagaagagaggcaacuacagcagacuggacgacagacaggugagacccgugagcaacggcgaccuguacuacaucggcaccuga

SEQ ID NO: 141 - RNA, 1641 nt, Artificial Sequence
  derived and/or modified CDS sequence (opt4) from Hendra henipavirus__AAB39505__F
auggccacccaggaggugagacugaagugccugcugugcggcaucaucgugcuggugcugagccuggagggccugggcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugcugaucugcagcugcuucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcagagagcagacccugcugaugaucgacaacaccaccugcaccaccguggugcugggcaacaucaucaucagccugcccaaguaccugggcagcaucaagcugcaggugcugagagcccugcugcugggccaccagagcauccagaccaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 142 - RNA, 1809 nt, Artificial Sequence
  derived and/or modified CDS sequence (opt4) from Nipah henipavirus__AAK50554__G
augcccgccgagaacaagaaggugagauucgagaacaccaccagcgacaagggcaagauccccagcaaggugaucaagagcuacuacggcaccauggacaucaagaagaucaacgagggccugcuggacagcaagauccugagcgccuucaacaccgugaucgcccugcugggcagcaucgugaucaucgugaugaacaucaugaucauccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaaggugguguucaucgagaucagcgaccagagacugagcaucggcagccccagcaagaucuacgacagccugggccagcccguguucuaccaggccagcuucagcugggacaccaugaucaaguucggcgacgugcugaccgugaacccccugguggugaacuggagaaacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 143 - RNA, 1809 nt, Artificial Sequence
  derived and/or modified CDS sequence (opt4) from Nipah henipavirus__AEZ01389__G
augcccaccgagagcaagaaggugagauucgagaacaccgccagcgacaagggcaagaaccccagcaaggugaucaagagcuacuacggcaccauggacaucaagaagaucaacgagggccugcuggacagcaagauccugagcgccuucaacaccgugaucgcccugcugggcagcaucgugaucaucgugaugaacaucaugaucauccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccauccugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaaguacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 144 - RNA, 1809 nt, Artificial Sequence
  derived and/or modified CDS sequence (opt4) from Nipah henipavirus__ACT32615__G
augcccaccgagagcaagaaggugagauucgagaacaccgccagcgacaagggcaagaaccccagcaaggugaucaagagcuacuacggcaccauggacaucaagaagaucaacgagggccugcuggacagcaagauccugagcgccuucaacaccgugaucgcccugcugggcagcaucgugaucaucgugaugaacaucaugaucauccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccgugcugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaaguacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 145 - RNA, 1809 nt, Artificial Sequence
  derived and/or modified CDS sequence (opt4) from Nipah henipavirus__CAF25497__G
augcccgccgagaacaagaaggugagauucgagaacaccaccagcgacaagggcaagaaccccagcaaggugaucaagagcuacuacggcaccauggacaucaagaagaucaacgagggccugcuggacagcaagauccugagcgccuucaacaccgugaucgcccugcugggcagcaucgugaucaucgugaugaacaucaugaucauccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacgugugggccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaaggugguguucaucgagaucagcgaccagagacugagcaucggcagccccagcaagaucuacgacagccugggccagcccguguucuaccaggccagcuucagcugggacaccaugaucaaguucggcgacgugcugaccgugaacccccugguggugaacuggagaaacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 146 - RNA, 1809 nt, Artificial Sequence
  derived and/or modified CDS sequence (opt4) from Nipah henipavirus__CBM41034__G
augcccgccgagaacaagaaggugagauucgagaacaccaccagcgacaagggcaagaaccccagcaaggugaucaagagcuacuacggcaccauggacaucaagaagaucaacgagggccugcuggacagcaagauccugagcgccuucaacaccgugaucgcccugcugggcagcaucgugaucaucgugaugaacaucaugaucauccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccgacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaagaucguguucaucgagaucagcgaccagagacugagcaucggcagccccagcaagguguacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 147 - RNA, 1809 nt, Artificial Sequence
  derived and/or modified CDS sequence (opt4) from Nipah henipavirus__AAX51853__G
augcccgccgagagcaagaaggugagauucgagaacaccaccagcgacaagggcaagauccccagcaagaucaucaagagcuacuacggcaccauggacaucaagaagaucaacgagggccugcuggacagcaagauccugagcgccuucaacaccgugaucgcccugcugggcagcaucgugaucaucgugaugaacaucaugaucauccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagaagaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacgacggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacgugcugagaagcggccugcugaaguacaaccugagcgacggcgagaaccccaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugagcuggagagacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 148 - RNA, 1809 nt, Artificial Sequence
  derived and/or modified CDS sequence (opt4) from Nipah henipavirus__AEZ01397__G
augcccaccgagagcaagaaggugagauucgagaacaccgccagcgacaagggcaagaaccccagcaaggugaucaagagcuacuacggcaccauggacaucaagaagaucaacgagggccugcuggacagcaagauccugagcgccuucaacaccgugaucgcccugcugggcagcaucgugaucaucgugaugaacaucaugaucauccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccauccugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaccuacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 149 - RNA, 1815 nt, Artificial Sequence
  derived and/or modified CDS sequence (opt4) from Hendra henipavirus__NP_047112__G
augauggccgacagcaagcuggugagccugaacaacaaccugagcggcaagaucaaggaccagggcaaggugaucaagaacuacuacggcaccauggacaucaagaagaucaacgacggccugcuggacagcaagauccugggcgccuucaacaccgugaucgcccugcugggcagcaucaucaucaucgugaugaacaucaugaucauccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 150 - RNA, 1815 nt, Artificial Sequence
  derived and/or modified CDS sequence (opt4) from Hendra henipavirus__AEB21225__G
augauggccgacagcaagcuggugagccugaacaacaaccugagcggcaagaucaaggaccagggcaaggugaucaagaacuacuacggcaccauggacaucaagaagaucaacgacggccugcuggacagcaagauccugggcgccuucaacaccgugaucgcccugcugggcagcaucaucaucaucgugaugaacaucaugaucauccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucacccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 151 - RNA, 1815 nt, Artificial Sequence
  derived and/or modified CDS sequence (opt4) from Hendra henipavirus__AEB21216__G
augauggccgacagcaagcuggugagccccaacaacaaccugagcggcaagaucaaggaccagggcaaggugaucaagaacuacuacggcaccauggacaucaagaagaucaacgacggccugcuggacagcaagauccugggcgccuucaacaccgugaucgcccugcugggcagcaucaucaucaucgugaugaacaucaugaucauccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaacaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 152 - RNA, 1815 nt, Artificial Sequence
  derived and/or modified CDS sequence (opt4) from Hendra henipavirus__AEB21206__G
augauggccgacagcaagcuggugagccugaacaacaaccugagcggcaagaucaaggaccagggcaaggugaucaagaacuacuacggcaccauggacaucaagaagaucaacgacggccugcuggacagcaagauccugggcgccuucaacaccgugaucgcccugcugggcagcaucaucaucaucgugaugaacaucaugaucauccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcaacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacaucgacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 153 - RNA, 1815 nt, Artificial Sequence
  derived and/or modified CDS sequence (opt4) from Hendra henipavirus__AEQ38052__G
augauggccgacagcaagcuggugagccugaacaacaaccugagcggcaagaucaaggaccagggcaaggugaucaagaacuacuacggcaccauggacaucaagaagaucaacgacggccugcuggacagcaagauccugggcgccuucaacaccgugaucgcccugcugggcagcaucaucaucaucgugaugaacaucaugaucauccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucaccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 154 - RNA, 1815 nt, Artificial Sequence
  derived and/or modified CDS sequence (opt4) from Hendra henipavirus__AEQ38115__G
augauggccgacagcaagcuggugagccugaacaacaaccugagcggcaagaucaaggaccagggcaaggugaucaagaacuacuacggcaccauggacaucaagaagaucaacgacggccugcuggacagcaagauccugggcgccuucaacaccgugaucgcccugcugggcagcaucaucaucaucgugaugaacaucaugaucauccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacaacggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 155 - RNA, 1815 nt, Artificial Sequence
  derived and/or modified CDS sequence (opt4) from Hendra henipavirus__AEQ38108__G
augauggccgacagcaagcuggugagccugaacaacaaccugagcggcaagaucaaggaccagggcaaggugaucaagaacuacuacggcaccauggacaucaagaagaucaacgacggccugcuggacagcaagauccugggcgccuucaacaccgugaucgcccugcugggcagcaucaucaucaucgugaugaacaucaugaucauccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucaccaucaccaagguggagagaggcaaguacgacaaggugaugcccuacggccccagcggcaucaagcagggcaacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 156 - RNA, 1815 nt, Artificial Sequence
  derived and/or modified CDS sequence (opt4) from Hendra henipavirus__AAV80426__G
augauggccgacagcaagcuggugagccugaacaacaaccugagcggcaagaucaaggaccagggcaaggugaucaagaacuacuacggcaccauggacaucaagaagaucaacgacggccugcuggacagcaagauccugggcgccuucaacaccgugaucgcccugcugggcagcaucaucaucaucgugaugaacaucaugaucauccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagugcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcagcuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 157 - RNA, 1641 nt, Artificial Sequence
  derived and/or modified CDS sequence (opt5) from Nipah henipavirus__AAK50553__F
augguggucauccuggacaagagaugcuacuguaaccuccugauucuuauccugaugauuagcgagugcuccguuggcauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgaccgaggacuuugaugaccuccuggagagcgauucuauuacaggacagaucauuuacgucgaccuguccagcuauuacaucauugugcgcguuuauuucccuauccucaccgaaauccaacaggccuacauucaggagcugcuucccguguccuuuaacaaugacaacucugaauggaucagcauugucccuaauuucauccuggugagaaacacccucauuuccaauaucgagauuggcuuuugucugaucacaaagcggagcguuaucugcaaccaggauuaugcuacgccgaugaccaauaacaugcgcgaaugucuuacagggucuaccgagaaaugccccagagagcugguggucuccagccacgugccucgguucgcccucucuaauggaguccuguuugcuaacuguauuagcgugacaugccaaugucagaccacgggccgcgccaucucccagucuggcgaacaaacacugcucaugauugacaauacaaccugccccaccgccguucuggggaacgugaucauuagccuuggaaaguaccugggcuccgucaauuacaacagcgaggggaucgcuaucggaccucccguguucaccgauaagguugacauuucuucccagaucagcucuaugaaucagucccuccagcaaagcaaagauuauauuaaggaagcgcagagacugcuggacacagugaacccgucccuuaucucuaugcucagcaugauuauccuguacguccuguccaucgccucucucugcauuggccugaucacguuuauuagcuucaucauuguggagaaaaagcggaacaccuauucccgccuugaagauagacgggugcgcccuacaagcucuggggaccuguacuauaucggaaccuga

SEQ ID NO: 158 - RNA, 1641 nt, Artificial Sequence
  derived and/or modified CDS sequence (opt5) from Nipah henipavirus__AEZ01388__F
auggccgugauccugaacaagagauacuauagcaaucuccugauucuuauccugauuaucuccgagugcucugucggcauucuccacuacgaaaaacugagcaagaucgggcuuguuaaaggaaucacccggaaguauaaaauuaaguccaacccccugacaaaggacaucgugauuaaaaugaucccuaaugugucuaacaugagccaguguacgggcuccgucauggagaauuacaagacccgccucaacgggauucugacaccgaucaaaggagcucuggaaauuuauaagaauaacacccaugaucucgugggcgacguuagacuggccggggugaucauggcgggagucgcuaucggcauugccacagccgcucaaaucaccgccggcguggcucuuuacgaggccaugaaaaaugcggauaacauuaauaagcugaagucuagcaucgaauccacaaacgaggccguugugaaacuccaggagaccgcugaaaagacggucuaugugcugaccgcccuucaggacuacauuaauacaaaccuggugcccaccaucgauaaaaucagcugcaagcagacagagcucucucuggaccuggcucucuccaaauaccugagcgaucuucuguucgucuuugggccuaaucuccaagaccccguuucuaacuccaugaccauucaggccaucagccaggcguucggaggcaacuaugaaacgcugcuucggacacugggguacgccaccgaggauuuugacgaucuccuggagucugacuccauuacaggacagaucauuuauguggaucugagcggcuacuauaucaucgugcgcgucuacuucccuauucucaccgaaauccaacaggcuuauauucaggagcugcuucccguguccuuuaauaacgacaauucugaauggaucagcauuguuccuaacuucauccuggugagaaauacccucauuuccaacaucgagaucggguuuugucugauuacaaagcggagcgucaucugcaaucaggacuacgccacgccgaugaccaacaauaugcgcgaaugucuuacaggaucuaccgagaaaugccccagagagcuggugguuuccagccacgugccucgguucgcucucucuaacggcguccuguuugccaauuguauuagcgugacaugccaaugucagaccacgggccgcgccaucucccagucuggggaacaaacacugcucaugauugauaacacaaccugccccaccgcuguccugggaaaugugaucaucagccuuggcaaguaccugggguccguuaacuauaauagcgagggaauugcgaucggcccucccguguucaccgacaaggucgauauuucuucccagaucagcucuaugaaccagucccuccagcaaagcaaagacuacauuaaggaagcccagagacugcuggauacagugaacccgucccuuaucucuaugcucagcaugaucauucuguauguucuguccaucgcuucucucuguauugggcugaucacguuuauuagcuucaucaucguggagaaaaagcggaauaccuacucccgccuugaagacagacggguccgcccuacaagcucuggagaucuguauuacauuggcaccuga

SEQ ID NO: 159 - RNA, 1641 nt, Artificial Sequence
  derived and/or modified CDS sequence (opt5) from Nipah henipavirus__AAY43915__F
auggccgugauccugaacaagagauacuauagcaaucuccugauucuuauccugaugauuuccgagugcucugucggcauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauacagcucugaucugcuuuucgucuuugggccuaaucugcaagaccccguuuccaacagcaugaccauccaggccauuucucaggcguucggaggcaacuaugaaacgcuccugcggacacuuggguacgccaccgagggauuugaugaccugcucgaguccgauagcaucacaggccagauuaucuauguggaccuguccggguacuauauuaucgugcgcgucuacuucccuauccugaccgaaauucaacaggcuuauauccaggagcuccugcccgugucuuuuaauaacgauaauagcgaauggauuuccaucguuccuaacuucauucuugugagaaauacccugaucagcaacauugagaucggauuuugucucaucacaaagcggucugucauuugcaaucaggacuacgccacgccgaugaccaacaauaugcgcgaaugucugacaggcuccaccgagaaaugccccagagagcuugugguuagcucucacgugccucgguucgcucugagcaacggcguccucuuugccaauuguaucuccgugacaugccaaugucagaccacggggcgcgccauuucucagagcggagaacaaacacugcugaugaucgacaacacaaccugccccaccgcuguccucggcaaugugauuaucucccuggggaaguaccuuggaagcguuaacuauaauucugagggcaucgcgauugggccucccguguucaccgauaaggucgacaucuccagccagauuucuuccaugaaccagagccugcagcaauccaaagauuacaucaaggaagcccagagacuccuggacacagugaacccgucucugauuagcaugcuuuccaugaucauccucuauguucugucuauugcuagccuguguaucggacucauuacguuuaucuccuucauuaucguggagaaaaagcggaauaccuacagccgccuggaagauagacggguccgcccuacaucuuccggcgaccuuuauuacaucggcaccuga

SEQ ID NO: 160 - RNA, 1641 nt, Artificial Sequence
  derived and/or modified CDS sequence (opt5) from Nipah henipavirus__CAF25496__F
augguggucauccuggacaagagaugcuacuguaaccuccugauucuuauccugaugauuagcgagugcuccguuggcauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgauugaggacuuugaugaccuccuggagagcgauucuaucaccggacagauuaucuacgucgaccuguccagcuauuacauuaucgugcgcguuuauuucccuauccucacagaaauucaacaggccuacauccaggagcugcuucccguguccuuuaacaaugacaacucugaauggauuagcaucgucccuaauuucauucuggugagaaacacccucaucuccaauauugagaucggcuuuugucugaucaccaagcggagcguuauuugcaaccaggauuaugcuacaccgaugacgaauaacaugcgcgaaugucuuaccgggucuacagagaaaugccccagagagcugguggucuccagccacgugccucgguucgcccucucuaauggaguccuguuugcuaacuguaucagcgugaccugccaaugucagacaaccggccgcgccauuucccagucuggcgaacaaacgcugcucaugaucgacaauacaaccugccccaccgccguucuggggaacgugauuaucagccuuggaaaguaccugggcuccgucaauuacaacagcgaggggaucgcuauuggaccucccguguucacagauaagguugacaucucuucccagauuagcucuaugaaucagucccuccagcaaagcaaagauuauaucaaggaagcgcagagacugcuggacaccgugaacccgucccuuauuucuaugcucagcaugaucauccuguacguccuguccauugccucucucugcaucggccugauuacauuuaucagcuucauuaucguggagaaaaagcggaacacguauucccgccuugaagauagacgggugcgcccuaccagcucuggggaccuguacuauaucggaacauga

SEQ ID NO: 161 - RNA, 1641 nt, Artificial Sequence
  derived and/or modified CDS sequence (opt5) from Nipah henipavirus__AAM13405__F
augguggucauccuggacaagagaugcuacuguaaccuccugauucuuauccugaugauuagcgagugcuccguuggcauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgaccgaggacuuugaugaccuccuggagagcgauucuauuacaggacagaucauuuacgucgaccuguccagcuauuacaucauugugcgcguuuauuucccuauccucaccgaaauccaacaggccuacauucaggagcugcuucccguguccuuuaacaaugacaacucugaauggaucagcauugucccuaauuucauccuggugagaaacacccucauuuccaauaucgagauuggcuuuugucugaucacaaagcggagcguuaucugcaaccaggauuaugcuacgccgaccacaaauaacaugcgcgaaugucuuaccgggucuacagagaaaugccccagagagcugguggucuccagccacgugccucgguucgcccucucuaauggaguccuguuugcuaacuguauuagcgugaccugccaaugucagacgacaggccgcgccaucucccagucuggcgaacaaacccugcucaugauugacaauaccacaugccccaccgccguucuggggaacgugaucauuagccuuggaaaguaccugggcuccgucaauuacaacagcgaggggaucgcuaucggaccucccguguucacagauaagguugacauuucuucccagaucagcucuaugaaucagucccuccagcaaagcaaagauuauauuaaggaagcgcagagacugcuggacacggugaacccgucccuuaucucuaugcucagcaugauuauccuguacguccuguccaucgccucucucugcauuggccugaucaccuuuauuagcuucaucauuguggagaaaaagcggaacacauauucccgccuugaagauagacgggugcgcccuaccagcucuggggaccuguacuauaucggaacauga

SEQ ID NO: 162 - RNA, 1641 nt, Artificial Sequence
  derived and/or modified CDS sequence (opt5) from Nipah henipavirus__CBM41033__F
augguggucauccuggacaagagaugcuacagcaaccuccugauucuuauccugaugauuuccgaguguucuguuggcauccuccacuaugaaaaacugagcaagauugggcuugugaaaggagugacccggaaguacaaaaucaaguccaauccccugacaaaggauaucgucauuaaaaugaucgccaacgugucuaauaugagccagugcacgggcuccguuauggagaacuauaagacccgccucaaugggauucugacaccuaucaaaggagcucuggaaauuuacaagaacaauacccaugaccucgugggcgaugucagacuggccggggugaucauggcgggaguugcuauuggcaucgccacagccgcucaaaucaccgccggcguggcucuuuaugaggccaugaaaaacgcggacaauauuaacaagcugaagucuagcaucgaauccacaaaugaggccgucgugaaacuccaggagaccgcugaaaagacgguguacguccugaccgcccuucaggauuauauuaacacaaaucugguuccgaccaucgacaaaauuagcuguaagcagacagagcucucucuggaucuggcucucuccaaauaccugagcgaccuucuguucguguuugggcccaaccuccaagauccugugucuaauuccaugaccauccaggccaucagccaggcguucggaggcaacuacgaaacgcugcuucggacacugggguaugccaccgaggacuuugaugaccuccuggagucugauuccauuacaggacagaucauuuacgucgaccugagcuccuauuacaucauugugcgcguuuauuuccccauccucaccgaaauccaacaggcuuacauucaggagcugcuuccugugucuuuuaacaaugacaacagcgaauggaucuccauuguccccaauuucauccuggugagaaacacccucauuagcaauaucgagauuggcuuuugccugaucacaaagcggucuguuaucuguaaccaggauuaugccacgccuaugaccaauaacaugcgcgaaugccuuacaggguccaccgagaaauguccgagagagcugguggucagcucucacgugccccgguucgcucucagcaauggaguccuguuugccaacugcauuuccgugacaugucaaugccagaccacgggccgcgccaucucucagagcggcgaacaaacacugcucaugauugacaauaccaccuguccuacagcuguucuggggaacgugaucauuucccuuggaaaguaccugggcagcgucaauuacaacucugaggggaucgcgaucggacccccuguguucaccgauaagguugacauuuccagccagaaaucuuccaugaaucagagccuccagcaauccaaggauuauaucaaagaagcccagagacugcuggacacagugaaccccucucuuauuagcaugcucuccaugaucauucuguacguccugucuaucgcuagccucugcaucggccugauuacguuuaucuccuucauuaucguggagaagaaacggaacaccuauagccgccuugaagauagacgggugcgcccgacaucuuccggggaccuguacuauauuggaaccuga

SEQ ID NO: 163 - RNA, 1641 nt, Artificial Sequence
  derived and/or modified CDS sequence (opt5) from Nipah henipavirus__AEZ01396__F
auggccgugauccugaacaagagauacuauagcaaucuccugauucuuauccugaugauuuccgagugcucugucggcauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauaccugagcgaucuucuguucgucuuugggccuaaucuccaagaccccguuucuaacuccaugaccauccaggccauuagccaggcguucggaggcaacuaugaaacgcugcuucggacacugggguacgccaccgaggauuuugacgaucuccuggagucugacuccaucacaggacagauuaucuauguggaucugagcggcuacuauauuaucgugcgcgucuacuucccuauccucaccgaaauucaacaggcuuauauccaggagcugcuucccguguccuuuaauaacgacaauucugaauggauuagcaucguuccuaacuucauucuggugagaaauacccucaucuccaacauugagaucggguuuugucugaucacaaagcggagcgucauuugcaaucaggacuacgccacgccgaugaccaacaauaugcgcgaaugucuuacaggaucuaccgagaaaugccccagagagcuggugguuuccagccacgugccucgguucgcucucucuaacggcguccuguuugccaauuguaucagcgugacaugccaaugucagaccacgggccgcgccauuucccagucuggggaacaaacacugcucaugaucgauaacacaaccugccccaccgcuguccugggaaaugugauuaucagccuuggcaaguaccugggguccguuaacuauaauagcgagggaaucgcgauuggcccucccguguucaccgacaaggucgauaucucuucccagauuagcucuaugaaccagucccuccagcaaagcaaagacuacaucaaggaagcccagagacugcuggauacagugaacccgucccuuauuucuaugcucagcaugaucauccuguauguucuguccauugcuucucucuguaucgggcugauuacguuuaucagcuucauuaucguggagaaaaagcggaauaccuacucccgccuugaagacagacggguccgcccuacaagcucuggagaucuguauuacaucggcaccuga

SEQ ID NO: 164 - RNA, 1641 nt, Artificial Sequence
  derived and/or modified CDS sequence (opt5) from Hendra henipavirus__NP_047111__F
auggccacccaggaggugagacugaagugccuccuguguggcaucauuguccuuguucugagccucgaagggcugggaauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaaaaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucgccgggcaaauugucuauguggaucugucuuccuacuauaucauuguucggguguacuucccuauccuuaccgagauucagcaggcuuauguccaggaacugcuccccgugagcuuuaacaacgacaauuccgaguggaucucuaucguuccuaacuucgugcugauucgcaauacccuuaucagcaacauugaagucaaguacugccugaucacaaagaaguccgugauuuguaaucaagacuaugccacgccgaugaccgccagcgucagagagugccucacaggaucuaccgauaaguguccccgggagcuggugguuuccagccacgugccucgcuuugcucugucuggcggcguccucuucgcgaacugcaucagcgugacaugucagugccagaccacggggagagccauuucccaaucuggagaacagacacugcuuaugaucgacaauaccaccuguacaaccguugugcugggcaacaucauuaucagccucgggaaauaccugggauccauuaauuacaacagcgagucuaucgcugucgggcccccuguguauacagauaagguggacauuuccagccagaucucuuccaugaaucagagccugcaacaguccaaagauuacaucaaggaagcccagaaaauucuugacacgguuaaccccucucucaucagcaugcuguccaugauuauccuguauguccucucuauugccgcucugugcaucggccuuaucaccuuuauuagcuucgugaucguggagaagaagcggggaaauuacucccgccuggaugacagacagguccggccggugagcaacggcgaucucuauuacauuggcacauga

SEQ ID NO: 165 - RNA, 1641 nt, Artificial Sequence
  derived and/or modified CDS sequence (opt5) from Hendra henipavirus__AEB21233__F
auggccacccaggaggugagacugaagugccuccuguguggcaucauuguccuuguucugagccucgaagggcugggaauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucaccgggcaaauugucuauguggaucugucuuccuacuauaucauuguucggguguacuucccuauccuuaccgagauucagcaggccuauguccaggaacugcuccccgugagcuuuaacaacgacaauuccgaguggaucucuaucguuccuaacuucgugcugauucgcaauacacuuaucagcaacauugaagucaaguacugccugaucacgaaaaaguccgugauuuguaaucaagacuaugcuaccccgaugacagccagcgucagagagugccucaccggaucuacagauaaguguccccgggagcuggugguuuccagccacgugccucgcuuugcccugucuggcggcguccucuucgcuaacugcaucagcgugaccugucagugccagacgacagggagagcgauuucccaaucuggagaacagacccugcuuaugaucgacaauaccacauguaccacaguugugcugggcaacaucauuaucagccucgggaaauaccugggauccauuaauuacaacagcgagucuaucgccgucgggcccccuguguauacggauaagguggacauuuccagccagaucucuuccaugaaucagagccugcaacaguccaaagauuacaucaaggaagcucagaaaauucuugacaccguuaaccccucucucaucagcaugcuguccaugauuauccuguauguccucucuauugccgcccugugcaucggccuuaucacauuuauuagcuucgugaucguggagaagaagcggggaaauuacucccgccuggaugacagacagguccggccggugagcaacggcgaucucuauuacauuggcaccuga

SEQ ID NO: 166 - RNA, 1641 nt, Artificial Sequence
  derived and/or modified CDS sequence (opt5) from Hendra henipavirus__AEQ38114__F
auggccacccaggaggugagacugaagugccuccuguguggcaucauuguccuuguucugagccucgaagggcugggaauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucaccgggcaaauugucuauguggaucugucuuccuacuauaucauuguucggguguacuucccuauccuuaccgagauucagcaggccuauguccaggaacugcuccccgugagcuuuaacaacgacaauuccgaguggaucucuaucguuccuaacuucgugcugauucgcaauacacuuaucagcaacauugaagucaaguacugccugaucacgaaaaaguccgugauuuguaaucaagacuaugcuaccccgaugacagccagcgucagagagugccucaccggaucuacagauaaguguccccgggagcuggugguuuccagccacgugccucgcuuugcccugucuggcggcguccucuucgcuaacugcaucagcgugaccugucagugccagacgacagggagagcgauuucccaaucuggagaacagacccugcuuaugaucgacaauaccacauguaccacaguugugcugggcaacaucauuaucagccucgggaaauaccugggauccauuaauuacaacagcgagucuaucgccgucgggcccccuguguauacggauaagguggacauuuccagccagaucucuuccaugaaucagagccugcaacaguccaaagauuacaucaaggaagcucagaaaauucuugacaccguuaaccccucucucaucagcaugcuguccaugauuauccuguauguccucucuauugccgcccugugcaucggccuuaucacauuuauuagcuucaucauuguggagaagaagcggggaaauuacucccgccuggaugacagacaggugcggccggucagcaacggcgaucucuauuacaucggcaccuga

SEQ ID NO: 167 - RNA, 1641 nt, Artificial Sequence
  derived and/or modified CDS sequence (opt5) from Hendra henipavirus__AAB39505__F
auggccacccaggaggugagacugaagugccuccuguguggcaucauuguccuuguucugagccucgaagggcugggaauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugcucauuugcucuuguuucggcccuaaucugcaggaucccguguccaacagcaugacgauccaggcgaucucucaggccuuugggggaaauuacgagacacuucugagaacccucggcuacgcuacagaggacuucgaugaccugcuggaauccgauagcauuaccgggcaaaucguguaugucgaccucucuuccuacuauauuaucgugcggguuuacuuuccuauucugaccgagauccagcaggccuaugugcaggaacuucugcccgucagcuucaacaacgauaauuccgaguggaucucuauugugccuaacuuuguucucauccgcaauacacugauuagcaacaucgaagugaaguacugccuuauuacgaaaaaguccgucaucuguaaucaagacuaugcuaccccgaugacagccagcgugagagagugccugaccggaucuacagacaaguguccccgggagcucgucguguccagccacguuccucgcuucgcccugucuggcggcgugcuguuugcuaacugcauuagcgucaccugucagugccagacgacagggagagcgaucucccaaucucgggaacagacccuccugaugaucgauaauaccacaugcaccacagugguucuuggaaacauuaucauuagccugcccaaauaccucggcuccaucaagcugcaagugcugcgcgcccuucuccuggggcaucagagcauucagacgaaagucgacaucucuucccagaucagcucuaugaaucagucccugcagcaaagcaaggauuacauuaaagaggcucagaagauccucgacaccgugaacccuucccugauuucuaugcuuagcaugaucauucuguaugugcucuccaucgccgcccuguguaucggacugauuacauucaucucuuuuguuauugucgaaaagaaaagaggcaauuacagccggcuugaugaccgccaggugagacccguguccaacggggaucucuauuacaucggaaccuga

SEQ ID NO: 168 - RNA, 1809 nt, Artificial Sequence
  derived and/or modified CDS sequence (opt5) from Nipah henipavirus__AAK50554__G
augcccgccgagaacaagaaagugagauucgaaaauaccacaagcgacaagggcaaaaucccuuccaaggucauuaaaucuuacuaugggacgauggauaucaagaagauuaacgagggacugcucgacagcaaaauccuguccgcuuuuaauaccguuauugcccuucugggcucuaucgugaucauugugaugaacaucaugauuauccagaauuacacacggagcaccgauaaccaagcggucauuaaggacgcucuccaggggauccagcagcaaauuaaaggacuggccgauaagaucggcacagaaaucgggccgaaagugucccuuauugacaccucuagcacaaucaccauucccgccaauaucggacugcucggcuccaagauuagccagucuacggcuuccaucaacgagaauguuaacgaaaagugcaaauucacccugccuccccugaagauccacgaguguaauauuagcugcccuaacccccucccuuuucgcgaguauagaccgcagacagaaggcgugucuaaucuggucgggcuucccaacaauaucugucugcagaaaaccuccaaccaaauucucaagccuaaacugaucagcuacacacuucccgugguuggacagucugggaccugcauuacggauccucugcucgccauggacgagggcuauuucgcuuacucccaucuggaacggaucggaagcuguucccgcggcgugucuaagcagagaaucauuggggucggagaggugcuggaucggggcgacgaggugcccagccucuuuaugacaaacgucuggaccccgccuaaucccaacacaguuuaucacugcuccgccguguacaauaacgaguucuacuaugugcugugugcggucagcaccgugggcgauccuauccuuaauucuaccuacugguccgggagccugaugaugacacgccucgccguuaaacccaagucuaacggaggcggguauaaucagcaucaacuggcucuuagaagcauugaaaagggacgguacgacaaagugaugcccuauggcccuuccgggaucaagcagggagauacgcuguacuuuccggccgucggcuuccucgugcgcaccgaauuuaaauauaacgacucuaauugccccauuacaaagugucaguacagcaaaccugagaacugcagacuguccaugggcauccggcccaauagccacuacauucugcgcucugggcuccugaaguauaaccuuuccgacggagaaaauccuaagguuguguucaucgagaucagcgaucaaagacugucuauuggcucccccagcaaaaucuacgacucccucgggcagccggucuuuuaucaggcuucuuucagcugggauaccaugauuaaguuuggagacgugcugacagucaacccucuugugguuaauuggcggaacaacaccgugaucucccgccccggccagucucaauguccuagauucaauacgugccccgagauuugcugggaaggggucuacaacgaugccuuccugaucgaccggaucaauuggauuagcgcgggcguguuucucgauuccaaccagacagccgagaauccuguuuucaccguguuuaaagacaacgaaauccuguauagagcucagcuggccagcgaggauaccaaugcucagaagacaauuaccaacuguuuccuccugaaaaauaagaucuggugcauuucucuugucgaaaucuacgacacaggagauaacgugauccgccccaagcuguuugccgugaaaauuccggagcaauguacguga

SEQ ID NO: 169 - RNA, 1809 nt, Artificial Sequence
  derived and/or modified CDS sequence (opt5) from Nipah henipavirus__AEZ01389__G
augcccaccgagagcaagaaagugagauucgaaaacacagccuccgacaagggcaaaaauccuucuaaggucaucaaaagcuacuaugggacgauggauauuaagaagaucaacgagggacugcucgacuccaaaauucugucugcuuuuaauaccguuaucgcccuucugggcagcauugugaucaucgugaugaacauuaugaucauucagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccauucuuaauucuaccuacuggagcggcucccugaugaugaccagacucgccguuaagccuaaaaacaauggggaaucuuauaaccagcaucaauuugcucugcggaauaucgaaaagggaaaauacgacaaggugaugcccuauggccccagcgggauuaaacagggagauacacuuuacuucccugccgucggcuuucuggugcgcacggaguucaaguauaacgacuccaauugcccgaucgcugaaugucaguacagcaagcccgagaacugcagacucucuauggggauucggccuaauucccacuacauccugcgcagcggacugcucaaauauaaccugucugacgaggaaaauuccaagauuguuuuuaucgagaucagcgaucaaagacuuuccauuggcucucccagcaaaaucuacgacucccugggccagccuguguucuaucaggccucuuuuagcugggauaccaugauuaaguucggggacguccagacagugaacccccucgucgugaacuggcgggauaauaccguuaucucccgcccgggacaaagccaguguccuagauucaacaaaugccccgaagugugcugggagggcgucuacaaugacgcguuucugauugaucggaucaacuggaucucugccgggguguuccuugacuccaaucagacagcugaaaacccuguuuuuaccguguucaaggauaaugagguccuguaucgcgcccagcucgcuagcgaggacacgaacgcccaaaagacaauuaccaauuguuuucugcugaaaaacaagaucuggugcauuucucucguggaaaucuacgauaccggagacaaugugauuagacccaaacuguucgccguuaagaucccugagcaguguacauga

SEQ ID NO: 170 - RNA, 1809 nt, Artificial Sequence
  derived and/or modified CDS sequence (opt5) from Nipah henipavirus__ACT32615__G
augcccaccgagagcaagaaagugagauucgaaaacacagccuccgacaagggcaaaaauccuucuaaggucaucaaaagcuacuaugggacgauggauauuaagaagaucaacgagggacugcucgacuccaaaauucugucugcuuuuaauaccguuaucgcccuucugggcagcauugugaucaucgugaugaacauuaugaucauucagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccguucuuaauucuaccuacuggagcggcucccugaugaugaccagacucgccgugaagccuaaaaacaauggggaaucuuauaaccagcaucaauuugcucugcggaauauugaaaagggaaaauacgacaaggucaugcccuauggccccagcgggaucaaacagggagauacacuuuacuucccugccgugggcuuucugguucgcacggaguucaaguauaacgacuccaauugcccgauugcugaaugucaguacagcaagcccgagaacugcagacucucuauggggauccggccuaauucccacuacauucugcgcagcggacugcucaaauauaaccugucugacgaggaaaauuccaagaucguguuuauugagaucagcgaucaaagacuuuccaucggcucucccagcaaaauuuacgacucccugggccagccugucuucuaucaggccucuuuuagcugggauaccaugaucaaguucggggacgugcagacagucaacccccucgugguuaacuggcgggauaauaccgugauuucccgcccgggacaaagccaguguccuagauucaacaaaugccccgaagucugcugggagggcguguacaaugacgcguuucugaucgaucggauuaacuggaucucugccgggguuuuccuugacuccaaucagacagcugaaaacccuguguuuaccgucuucaaggauaaugaggugcuguaucgcgcccagcucgcuagcgaggacacgaacgcccaaaagacaaucaccaauuguuuucugcugaaaaacaagauuuggugcaucucucucguggaaauuuacgauaccggagacaauguuaucagacccaaacuguucgccgucaagauuccugagcaguguacauga

SEQ ID NO: 171 - RNA, 1809 nt, Artificial Sequence
  derived and/or modified CDS sequence (opt5) from Nipah henipavirus__CAF25497__G
augcccgccgagaacaagaaagugagauucgaaaauaccacaagcgacaagggcaaaaacccuuccaaggucaucaaaucuuacuaugggacgauggauauuaagaagaucaaugagggacugcucgacagcaaaauucuguccgcuuuuaacaccguuaucgcccuucugggcucuauugugaucaucgugaugaauauuaugaucauucagaacuacacacggagcaccgauaaucaagcggucaucaaggacgcucuccaggggauucagcagcaaaucaaaggacuggccgauaagauuggcacagaaaucgggccgaaagugucccuuaucgacaccucuagcacaauuaccauccccgccaacauuggacugcucggcuccaagaucagccagucuacggcuuccauuaaugagaacguuaaugaaaagugcaaauucacccugccuccccugaagauccacgaguguaacaucagcugcccuaauccccucccuuuucgcgaguauagaccgcagacagaaggcgugucuaaccuggucgggcuucccaauaacauuugucugcagaaaaccuccaaccaaauccucaagccuaaacugauuagcuacacacuucccgugguuggacagucugggaccugcaucacggauccucugcucgccauggacgagggcuauuucgcuuacucccaucuggaacggauuggaagcuguucccgcggcgugucuaagcagagaaucaucggggucggagaggugcuggaucggggcgacgaggugcccagccucuuuaugacaaaugucugggccccgccuaaccccaauaccguuuaucacugcuccgcgguguacaacaaugaguucuacuaugugcugugugccgucagcacagugggcgauccuauucuuaacucuaccuacugguccgggagccugaugaugacccgccucgcuguuaaacccaagucuaauggaggcggguauaaccagcaucaacuggcccuuagaagcaucgaaaagggacgguacgacaaagugaugcccuauggcccuuccgggauuaagcagggagauacacuguacuuuccggcugucggcuuccucgugcgcacggaauuuaaauauaaugacucuaacugccccaucaccaagugucaguacagcaaaccugagaauugcagacuguccaugggcauucggcccaacagccacuacauccugcgcucugggcuccugaaguauaaucuuuccgacggagaaaacccuaagguuguguucauugagaucagcgaucaaagacugucuaucggcucccccagcaaaauuuacgacucccucgggcagccggucuuuuaucaggccucuuucagcugggauacaaugaucaaguuuggagacgugcugaccgucaauccucuugugguuaacuggcggaacaauacagugauuucccgccccggccagucucaauguccuagauucaauaccugccccgagaucugcugggaaggggucuacaacgaugcguuccugauugaccggaucaacuggaucagcgccggcguguuucucgauuccaaucagacggcugagaacccuguuuucacaguguuuaaagacaaugaaauucuguauagagcccagcuggcuagcgaggauaccaacgcccagaagaccaucacaaauuguuuccuccugaaaaacaagauuuggugcaucucucuugucgaaauuuacgacaccggagauaaugugauccgccccaagcuguuugccgugaaaaucccggagcaauguacauga

SEQ ID NO: 172 - RNA, 1809 nt, Artificial Sequence
  derived and/or modified CDS sequence (opt5) from Nipah henipavirus__CBM41034__G
augcccgccgagaacaagaaagugagauucgaaaauaccacaagcgacaagggcaaaaacccuuccaaggucaucaaaucuuacuaugggacgauggauauuaagaagaucaaugagggacugcucgacagcaaaauucuguccgcuuuuaacaccguuaucgcccuucugggcucuauugugaucaucgugaugaauauuaugaucauucagaacuacacacggagcaccgauaaucaagcggucaucaaggacgcucuccaggggauucagcagcaaaucaaaggacuggccgauaagauuggcacagaaaucgggccgaaagugucccuuaucgacaccucuagcacaauuaccauccccgccaacauuggacugcucggcuccaagaucagccagucuacggcuuccauuaaugagaacguuaaugaaaagugcaaauucacccugccuccccugaagauccacgaguguaacaucagcugcccuaauccccucccuuuucgcgaguauagaccgcagacagaaggcgugucuaaccuggucgggcuucccgauaauauuugucugcagaaaaccuccaaccaaauccucaagccuaaacugauuagcuacacacuucccgugguuggacagucugggaccugcaucacggacccucugcucgccauggaugagggcuauuucgcuuacucccaucuggaacggauuggaagcuguucccgcggcgugucuaagcagagaaucaucggggucggagaggugcuggaccggggcgaugaggugcccagccucuuuaugacaaacgucuggaccccgccuaaucccaacacaguuuaucacugcuccgccguguacaauaacgaguucuacuaugugcugugugcggucagcaccgugggcgacccuauucuuaauucuaccuacugguccgggagccugaugaugacacgccucgccguuaaacccaagucuaacggaggcggguauaaucagcaucaacuggcucuuagaagcaucgaaaagggacgguacgauaaagugaugcccuauggcccuuccgggauuaagcagggagacacgcuguacuuuccggccgucggcuuccucgugcgcaccgaauuuaaauauaacgacucuaauugccccaucacaaagugucaguacagcaaaccugagaacugcagacuguccaugggcauucggcccaauagccacuacauccugcgcucugggcuccugaaguauaaccuuuccgauggagaaaauccuaagauuguuuucaucgagaucagcgaccaaagacugucuauuggcucccccagcaaaguguacgauucccucgggcagccggucuuuuaucaggcuucuuucagcugggacaccaugaucaaguuuggagaugugcagacagucaacccucuggugguuaauuggcgggacaacaccgugauuucccgccccggccaaucucaguguccuagauucaacacgugccccgagaucugcugggaaggggucuacaaugaugccuuccuuauugaccggaucaacuggaucagcgcgggcguguuucuggauuccaaucagacagccgagaacccuguuuucaccguguuuaaagacaaugaaauucucuauagagcucagcuggccagcgaggauaccaacgcucaaaagacaaucaccaauuguuuccugcucaaaaacaagauuuggugcaucucucuggucgaaauuuacgacacaggagacaaugugauccgccccaaacuuuuugccgugaagaucccggagcaguguacguga

SEQ ID NO: 173 - RNA, 1809 nt, Artificial Sequence
  derived and/or modified CDS sequence (opt5) from Nipah henipavirus__AAX51853__G
augcccgccgagagcaagaaagugagauucgaaaacaccacauccgacaagggcaaaaucccuucuaagauuaucaaaagcuacuaugggacgauggauauuaagaagaucaaugagggacugcucgacuccaaaauucugucugcuuuuaacaccgucaucgcccuucugggcagcaucguuauuaucgugaugaauauuaugaucauucagaacuacacacgguccaccgauaaucaagcggugaucaaggacgcucuccaggggauucagcagcaaaucaaaggacuggccgauaagaucggcacagaaauugggccgaaagucucucuuaucgacaccagcuccacaauuaccauccccgccaacauuggacugcucggcagcaagaucucucaguccacggcuagcaucaaugagaacgugaaugaaaagugcaaauucacccugccuccccugaagauucacgaguguaacaucucuugcccuaauccccucccuuuucgcgaguauagaccgcagacagaaggcguuuccaaccugguggggcuucccaauaacauuugucugcagaaaaccagcaaucaaauccucaagccuaaacugauuucuuacacacuucccgucgugggacaguccgggaccugcaucacggauccucugcucgccauggacgagggcuauuucgcuuacagccaucuggaacggaucggauccuguucucgcggcguuagcaagcagaaaauuaucggggugggagagguccuggauagaggcgacgaggugcccucccucuuuaugacaaacguguggaccccgccuaaccccaauacagucuaucacugcagcgccguuuacaacaaugaguucuacuaugugcugugugcggugucuaccgucggcgauccuauucuuaacuccaccuacuggagcgggucucugaugaugacacggcucgccgugaagcccaagagcaaugacggaggcuauaaccagcaucaacuggcccuucgcuccaucgaaaaagggagauacgauaagguuaugcccuauggaccuucuggcauuaaacagggggacacgcuguacuuuccggcugugggauuccucguccggaccgaauuuaaguauaaugacagcaacugccccaucacaaaaugucaguacuccaagccugagaauugccgccugagcaugggcauuagacccaacucucacuacgugcugcgguccggccuccugaaguauaaucuuagcgauggggaaaacccuaaaaucguuuucaucgagauuucugaccaacgccuguccaucggaagccccuccaagauuuacgauucucucggccagccgguguuuuaucaggcuagcuucuccugggacaccaugaucaaauuuggggauguccagacagugaauccucuggucgugucuuggagagacaacaccguuauuagccggcccggacaaucccaguguccucgcuucaauacgugccccgagaucugcugggaaggcguguacaacgaugccuuccuuaucgacagaauuaacuggaucagcgcgggggucuuucuggauucuaaucagacagccgagaacccuguguucaccguuuuuaaggacaaugaaauucucuaucgggcucagcuggccuccgaggauaccaacgcucagaaaacaaucaccaauuguuuccugcucaagaacaagauuuggugcaucagccugguggaaaucuacgacacaggcgacaaugucauuagacccaaacuuuuugccgugaagaucccggagcaauguacguga

SEQ ID NO: 174 - RNA, 1809 nt, Artificial Sequence
  derived and/or modified CDS sequence (opt5) from Nipah henipavirus__AEZ01397__G
augcccaccgagagcaagaaagugagauucgaaaacacagccuccgacaagggcaaaaauccuucuaaggucaucaaaagcuacuaugggacgauggauauuaagaagaucaacgagggacugcucgacuccaaaauucugucugcuuuuaauaccguuaucgcccuucugggcagcauugugaucaucgugaugaacauuaugaucauucagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccauucuuaauucuaccuacuggagcggcucccugaugaugaccagacucgccguuaagccuaaaaacaauggggaaucuuauaaccagcaucaauuugcucugcggaauaucgaaaagggaaaauacgacaaggugaugcccuauggccccagcgggauuaaacagggagauacacuuuacuucccugccgucggcuuucuggugcgcacggaguucaccuauaacgacuccaauugcccgaucgcugaaugucaguacagcaagcccgagaacugcagacucucuauggggauucggccuaauucccacuacauccugcgcagcggacugcucaaguauaaccugucugacgaggaaaauuccaaaauuguuuuuaucgagaucagcgaucaaagacuuuccauuggcucucccagcaagaucuacgacucccugggccagccuguguucuaucaggccucuuuuagcugggauacaaugauuaaauucggggacguccagaccgugaacccccucgucgugaacuggcgggauaauacaguuaucucccgcccgggacaaagccaguguccuagauucaacaagugccccgaagugugcugggagggcgucuacaaugacgcguuucugauugaucggaucaacuggaucucugccgggguguuccuugacuccaaucagaccgcugaaaacccuguuuuuacgguguucaaagauaaugagguccuguaucgcgcccagcucgcuagcgaggacacaaacgcccaaaagaccauuaccaauuguuuucugcugaagaacaaaaucuggugcauuucucucguggaaaucuacgauacaggagacaaugugauuagacccaagcuguucgccguuaaaaucccugagcaguguaccuga

SEQ ID NO: 175 - RNA, 1815 nt, Artificial Sequence
  derived and/or modified CDS sequence (opt5) from Hendra henipavirus__NP_047112__G
augauggccgacagcaagcuggugucccucaacaauaaccugucuggcaaaaucaaggaucaggggaaagucauuaagaauuacuauggaaccauggacaucaaaaagauuaacgauggccuucuggacagcaagauccucggggcuuucaauacaguuauugcccugcuuggauccaucaucauuaucgugaugaacauuaugaucauucaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucgcgaucaccaagguggaacgggggaaauacgauaaggugaugccuuauggacccagcggcauuaaacaaggggacacacuguacuuucccgccgucggauuccugccucgcaccgaguuucaguauaaugauuccaacugcccgaucauucacuguaaguacagcaaagcugagaauugcagacucucuaugggcgugaacuccaagagccacuauauccugcggucugggcuucugaaguacaaucucucccugggaggcgacauuauccuucaguucaucgaaauugccgauaaccgccugacgaucggcagccccuccaaaauuuacaauucucucgggcaaccuguguuuuaucaggcuagcuacuccugggacacaaugaucaagcugggagauguugacaccgucgauccccugagagugcaguggcggaacaauucuguuauuagccgcccuggccagucccaaugucccagauucaacgugugcccggaggucugcugggaagggaccuauaaugacgccuuucucaucgaccggcugaacugggugagcgcgggagucuaccuuaacucuaaucagacagccgagaacccuguguucgcuguuuucaaagauaaugaaauccuguaucaggugccccucgccgaggacgauaccaacgcucagaagacaauuacggacuguuuucugcuggagaaugucaucuggugcauuucccuuguggaaaucuacgauaccggcgacagcguuauuagaccuaaacucuucgccgugaagauccccgcccaauguucugaguccuga

SEQ ID NO: 176 - RNA, 1815 nt, Artificial Sequence
  derived and/or modified CDS sequence (opt5) from Hendra henipavirus__AEB21225__G
augauggccgacagcaagcuggugucccucaacaauaaccugucuggcaaaaucaaggaucaggggaaagucauuaagaauuacuauggaaccauggacaucaaaaagauuaacgauggccuucuggacagcaagauccucggggcuuucaauacaguuauugcccugcuuggauccaucaucauuaucgugaugaacauuaugaucauucaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucgcgaucaccaagguggaacgggggaaauacgauaaggugaugccuuauggacccagcggcauuaaacaaggggacacacuguacuuucccgccgucggauuccugccucgcaccgaguuucaguauaaugauuccaacugcccgaucauucacuguaaguacagcaaagcugagaauugcagacucucuaugggcgugaacuccaagagccacuauauccugcggucugggcuucugaaguacaaucucucccugggaggcgacauuacgcuucaguucaucgaaaucgccgauaaccgccugacaauuggcagccccuccaaaaucuacaauucucucgggcaaccuguguuuuaucaggcuagcuacuccugggacaccaugauuaagcugggagauguugacaccgucgauccccugagagugcaguggcggaacaauucuguuaucagccgcccuggccagucccaaugucccagauucaacgugugcccggaggucugcugggaagggacauauaaugacgccuuucucauugaccggcugaacugggugagcgcgggagucuaccuuaacucuaaucagaccgccgagaacccuguguucgcuguuuucaaagauaaugaaauccuguaucaggugccccucgccgaggacgauacaaacgcucagaagacgaucaccgacuguuuucugcuggagaaugucauuuggugcaucucccuuguggaaauuuacgauacaggcgacagcguuaucagaccuaaacucuucgccgugaagauucccgcccaauguucugaguccuga

SEQ ID NO: 177 - RNA, 1815 nt, Artificial Sequence
  derived and/or modified CDS sequence (opt5) from Hendra henipavirus__AEB21216__G
augauggccgacagcaagcuggugucccccaacaauaaccucucuggcaaaaucaaggaucaggggaaagucauuaagaauuacuauggaaccauggacaucaaaaagauuaacgauggccugcuugacagcaagauccugggggcuuucaauacaguuauugcccuccugggauccaucaucauuaucgugaugaacauuaugaucauucaaaauuacacgagaaccacagauaaccaggcgcuuaucaaagagucucugcagagcgugcagcaacagauuaaggcucucaccgacaaaaucggcacagaaaucgggccuaaggucucccugauugauaccucuagcacaaucaccauuccggccaauaucggacugcucggcuccaaaauuagccagucuacguccagcaucaacgagaaugugaacgacaagugcaaguuuacccugcccccucuuaaaauccacgaauguaauauuucuugccccaacccucugcccuuccgggaguaucgcccuaucucccagggcguuagcgaucucguggggcugccgaaucaaauuugucuucagaagacaaccucuacaauccugaaacccagacucauuuccuacacccugccuaucaacacgcgggaaggagucugcaucacagacccccugcucgccguggauaacggcuuuuucgcuuauagccaucuggagaagauuggguccuguacccgcggaaucgccaaacagagaauuaucggcguuggggaggugcuugaccggggagauaaggucccuucuauguuuaugacaaauguguggacacccccgaacccuagcaccauucaccauugcuccagcaccuaccacgaagacuucuauuacacgcugugugcugugucucaugucggcgaccccauccucaauuccaccagcuggacagagucucugagccuuauucgccuggccguuagaccuaaauccgauucuggcgacuacaaccagaaguauaucgcgaucaauaagguggaacgggggaaauacgauaaggugaugcccuauggacccagcggcauuaaacaaggggacacccucuacuuuccugccgucggauuccugccgcgcacagaguuucaguauaacgauuccaauugccccaucauucacuguaaguacagcaaagcugagaacugcagacugucuaugggcguuaauuccaagagccacuauauccuccggucugggcugcuuaaguacaaccugucccucggaggcgacauuauccugcaguucaucgaaauugccgauaaucgccuuaccaucggcagcccuuccaaaauuuacaacucucuggggcaacccguguuuuaucaggcuagcuacuccugggacacgaugaucaagcucggagauguggacacagucgauccucugagagugcaguggcggaauaacucuguuauuagccgccccggccagucccaauguccgagauucaaugugugcccugaggucugcugggaagggaccuauaacgacgccuuucugaucgaccggcucaacugggugagcgcgggagucuaccuuaauucuaaccagaccgccgagaaucccguguucgcuguuuucaaagauaacgaaauccuguaucaggugccucuggccgaggacgauacaaaugcucagaagaccauuacagacuguuuucuccuggagaacgucaucuggugcauuucccugguggaaaucuacgauacgggcgacagcguuauuagacccaaacuuuucgccgugaagaucccugcccaauguucugaguccuga

SEQ ID NO: 178 - RNA, 1815 nt, Artificial Sequence
  derived and/or modified CDS sequence (opt5) from Hendra henipavirus__AEB21206__G
augauggccgacagcaagcuggugucccucaacaauaaccugucuggcaaaaucaaggaucaggggaaagucauuaagaauuacuauggaaccauggacaucaaaaagauuaacgauggccuucuggacagcaagauccucggggcuuucaauacaguuauugcccugcuuggauccaucaucauuaucgugaugaacauuaugaucauucaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcaacuacaaucagaaguauaucgcgaucaccaagguggaacgggggaaauacgacaaggugaugccuuauggacccagcggcauuaaacaaggggauacacuguacuuucccgccgucggauuccugccucgcaccgaguuucaguauaacgacuccaauugcccgaucauucacuguaaguacagcaaagcugagaacugcagacucucuaugggcguuaauuccaagagccacuauauccugcggucugggcuucugaaguacaaccucucccugggaggcgauauuauccuucaguucaucgaaauugccgacaaucgccugacgaucggcagccccuccaaaauuuacaacucucucgggcaaccuguguuuuaucaggcuagcuacuccugggauacaaugaucaagcugggagacauugauaccguggacccccugagaguccaguggcggaauaacucugugaucagccgcccuggccagucccaaugucccagauucaauguuugcccggaggugugcugggaagggaccuauaacgaugccuuucucaucgaccggcugaacugggucagcgcgggaguguaccuuaauucuaaccagacagccgagaauccugucuucgcuguguucaaagacaacgaaauucuguaucagguuccccucgccgaggaugacaccaaugcucagaagacaaucacggauuguuuucugcuggagaacgugauuuggugcaucucccuugucgaaauuuacgacaccggcgauagcgugaucagaccuaaacucuucgccguuaagauccccgcccaauguucugaguccuga

SEQ ID NO: 179 - RNA, 1815 nt, Artificial Sequence
  derived and/or modified CDS sequence (opt5) from Hendra henipavirus__AEQ38052__G
augauggccgacagcaagcuggugucccucaacaauaaccugucuggcaaaaucaaggaucaggggaaagucauuaagaauuacuauggaaccauggacaucaaaaagauuaacgauggccuucuggacagcaagauccucggggcuuucaauacaguuauugcccugcuuggauccaucaucauuaucgugaugaacauuaugaucauucaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucaccaucacaaagguggaacgggggaaauacgauaaggugaugccuuauggacccagcggcauuaaacaaggggacacccuguacuuucccgcggucggauuccugccucgcacggaguuucaguauaaugauuccaacugcccgaucauucacuguaaguacagcaaagccgagaauugcagacucucuaugggcgugaacuccaagagccacuauauccugcggucugggcuucugaaguacaaucucucccugggaggcgacauuauccuucaguucaucgaaauugcugauaaccgccugacaaucggcagccccuccaaaauuuacaauucucucgggcaaccuguguuuuaucaggccagcuacuccugggacaccaugaucaagcugggagauguugacaccgucgauccccugagagugcaguggcggaacaauucuguuauuagccgcccuggccagucccaaugucccagauucaacgugugcccggaggucugcugggaagggacauauaaugacgcuuuucucaucgaccggcugaacugggugagcgccggagucuaccuuaacucuaaucagaccgcggagaacccuguguucgccguuuucaaagauaaugaaauccuguaucaggugccccucgcugaggacgauacaaacgcccagaagacgauuaccgacuguuuucugcuggagaaugucaucuggugcauuucccuuguggaaaucuacgauacaggcgacagcguuauuagaccuaaacucuucgcugugaagauccccgcccaauguucugaguccuga

SEQ ID NO: 180 - RNA, 1815 nt, Artificial Sequence
  derived and/or modified CDS sequence (opt5) from Hendra henipavirus__AEQ38115__G
augauggccgacagcaagcuggugucccucaacaauaaccugucuggcaaaaucaaggaucaggggaaagucauuaagaauuacuauggaaccauggacaucaaaaagauuaacgauggccuucuggacagcaagauccucggggcuuucaauacaguuauugcccugcuuggauccaucaucauuaucgugaugaacauuaugaucauucaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauaacggcgacuacaaucagaaguauaucgcgaucaccaagguggaacgggggaaauacgauaaggugaugccuuauggacccucuggcauuaaacaaggggacacacuguacuuucccgccgucggauuccugccucgcaccgaguuucaguauaacgauagcaauugcccgaucauucacuguaaguacuccaaagcugagaacugcagacucagcaugggcguuaauucuaagucccacuauauccugcggagcgggcuucugaaguacaaccucucucugggaggcgacauuauccuucaguucaucgaaauugccgauaaucgccugacgaucggcucccccagcaaaauuuacaacucccucgggcaaccuguguuuuaucaggcuucuuacagcugggacacaaugaucaagcugggagauguggacaccgucgauccccugagagugcaguggcggaauaacuccguuauuucucgcccuggccagagccaaugucccagauucaaugugugcccggaggucugcugggaagggaccuauaacgacgccuuucucaucgaccggcugaacuggguguccgcgggagucuaccuuaauagcaaccagacagccgagaauccuguguucgcuguuuucaaagauaacgaaauccuguaucaggugccccucgccgaggacgauaccaaugcucagaagacaauuacggacuguuuucugcuggagaacgucaucuggugcauuucucuuguggaaaucuacgauaccggcgacuccguuauuagaccuaaacucuucgccgugaagauccccgcccaauguagcgagucuuga

SEQ ID NO: 181 - RNA, 1815 nt, Artificial Sequence
  derived and/or modified CDS sequence (opt5) from Hendra henipavirus__AEQ38108__G
augauggccgacagcaagcuggugucccucaacaauaaccugucuggcaaaaucaaggaucaggggaaagucauuaagaauuacuauggaaccauggacaucaaaaagauuaacgauggccuucuggacagcaagauccucggggcuuucaauacaguuauugcccugcuuggauccaucaucauuaucgugaugaacauuaugaucauucaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucaccaucacaaagguggaacgggggaaauacgauaaggugaugccuuauggacccagcggcauuaaacaagggaauacccuguacuuucccgcggucggauuccugccucgcacggaguuucaguauaacgacuccaauugcccgaucauucacuguaaguacagcaaagccgagaacugcagacucucuaugggcguuaauuccaagagccacuauauccugcggucugggcuucugaaguacaaccucucccugggaggcgauauuauccuucaguucaucgaaauugcugacaaucgccugacaaucggcagccccuccaaaauuuacaacucucucgggcaaccuguguuuuaucaggccagcuacuccugggauaccaugaucaagcugggagacguggauaccgucgacccccugagagugcaguggcggaauaacucuguuauuagccgcccuggccagucccaaugucccagauucaaugugugcccggaggucugcugggaagggacauauaacgaugcuuuucucaucgaccggcugaacugggugagcgccggagucuaccuuaauucuaaccagaccgcggagaauccuguguucgccguuuucaaagacaacgaaauccuguaucaggugccccucgcugaggaugacacaaaugcccagaagacgauuaccgauuguuuucugcuggagaacgucaucuggugcauuucccuuguggaaaucuacgacacaggcgauagcguuauuagaccuaaacucuucgcugugaagauccccgcccaauguucugaguccuga

SEQ ID NO: 182 - RNA, 1815 nt, Artificial Sequence
  derived and/or modified CDS sequence (opt5) from Hendra henipavirus__AAV80426__G
augauggccgacagcaagcuggugucccucaacaauaaccugucuggcaaaaucaaggaucaggggaaagucauuaagaauuacuauggaaccauggacaucaaaaagauuaacgauggccuucuggacagcaagauccucggggcuuucaauacaguuauugcccugcuuggauccaucaucauuaucgugaugaacauuaugaucauucaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagugcacgucuuccaucaacgagaaugugaacgacaaguguaaguuuacccuuccgccccugaaaauccacgaaugcaauauuagcuguccuaacccccucccuuuccgggaguaucgccccaucucucagggcguuuccgaucugguggggcuuccuaaucaaauuugccugcagaagacaaccagcacaauccucaaaccgagacugauuucuuacacccugcccaucaacacgcgggaaggagucuguaucacagacccucuccuggccguggauaacggcuuuuucgcuuauucccaucuugagaagauugggagcugcacccgcggaaucgccaaacagagaauuaucggcguuggggaggugcuggaccggggagauaagguccccuccauguuuaugacaaauguguggaccccucccaacccgucuaccauucaccauuguagcuccacauaccacgaagacuucuauuacacgcucugcgcugugagccaugucggcgacccuauccuuaauucuaccuccuggacagagagccugucucugauucgccucgccguuagacccaaaagcgauuccggcgacuacaaccagaaguauaucgcgaucaccaagguggaacgggggaaauacgauaaggugaugccuuauggacccucuggcauuaaacaaggggacacacuguacuuucccgccgucggauuccugccucgcaccgaguuucaguauaaugauagcaacuguccgaucauucacugcaaguacuccaaagcugagaauuguagacucagcaugggcgugaacucuaagucccacuauauccugcggagcgggcuucugaaguacaaucucucucugggaggcgacauuauccuucaguucaucgaaauugccgauaaccgccugacgaucggcucccccagcaaaauuuacaauucccucgggcaaccuguguuuuaucaggcuucuuacagcugggacacaaugaucaagcugggagauguugacaccgucgauccccugagagugcaguggcggaacaauuccguuauuucucgcccuggccagagccaaugccccagauucaacgugugcccggaggucuguugggaaggguccuauaaugacgccuuucucaucgaccggcugaacugggugagcgcgggagucuaccuuaacucuaaucagaccgccgagaacccuguguucgcuguuuucaaagauaaugaaauccuguaucaggugccccucgccgaggacgauacaaacgcucagaagaccauuacagacugcuuucugcuggagaaugucaucugguguauuucccuuguggaaaucuacgauacgggcgacagcguuauuagaccuaaacucuucgccgugaagauccccgcccaaugcucugaguccuga

SEQ ID NO: 183 - RNA, 1641 nt, Artificial Sequence
  derived and/or modified CDS sequence (opt6) from Nipah henipavirus__AAK50553__F
augguugucauacuagacaaaagaugcuacugcaauuuacuaauucuuauacuaaugauaucugaauguucuguaggaauauuacauuacgaaaaacucucaaaaauaggauuagucaaaggaguaaccagaaaauauaaaaucaaauccaacccuuuaacaaaagacauagucauaaaaaugauccccaacguuagcaauaugucacaaugcacaggaucaguaauggaaaauuacaaaacaagacuaaacggcauucuaacucccaucaaaggagcacuugaaauauauaaaaacaauacucacgaccuuguaggagacguacgacuagccggaguaauuauggccggaguagcaauagguauagcgacagccgcgcaaauaacagcaggcgucgcacucuacgaagccaugaaaaacgcagauaauauaaacaaauuaaaaucauccauugaaagcaccaacgaagcaguaguaaaacuacaagaaaccgcagaaaaaacugucuauguacuaacagcauuacaagacuauaucaauacaaaccuagucccuacaaucgauaaaauaaguugcaaacaaaccgaacuaucauuagacuuagcauuaucaaaauaccuauccgacuuacuauucguauuuggccccaauuuacaagaccccguaucuaauaguaugacaauccaagccauaucucaagcauuuggaggaaacuaugaaacacuauuaagaacacuaggauacgcaacagaagacuucgacgaccuauuagaaucagauuccauaacaggacaaauaauauacguagaccuaucaucguauuacauaauaguaagaguauacuucccaauauuaacagaaauacaacaagcauacauacaagaauuacuacccguaucauucaauaaugacaacucagaauggauaagcauaguaccaaauuucauccucgucagaaacacauugauaaguaauauagaaaucgguuucugccuaaucacaaagagaucaguaauaugcaaccaagacuacgcaacaccaaugacaaacaauaugcgcgaaugcuuaacaggcucaacagaaaaaugcccaagagaacuagucguuucaucacacguaccacgauuugcccuauccaacggaguacuauuugccaacugcaucucaguaacaugccaaugucaaacuacaggacgagcuauuucccaauccggagaacaaacacuccucaugauagacaauacaacuuguccaacagcuguacuuggaaacguaauaauuucccucggcaaauaccuaggaucaguaaauuauaauucagaaggaauagccauaggacccccaguguucaccgacaaaguagacaucucaucccaaauuucaucaaugaaccaaucucuccaacaaucaaaagauuacaucaaagaagcacaaagacuauuagauaccguaaaccccucauuaauaucaaugcuaucaaugaucaucuuauacgucuuaucaauagcaucacuaugcauaggacucaucaccuuuauauccuuuaucauaguagaaaaaaaaagaaacaccuacuccagauuagaagauagacgaguaagaccuacaucaucaggagacuuauacuacaucggcacauaa

SEQ ID NO: 184 - RNA, 1641 nt, Artificial Sequence
  derived and/or modified CDS sequence (opt6) from Nipah henipavirus__AEZ01388__F
auggcaguaauacuaaacaaaagauauuacucaaaccuacucauacucauccuaaucauaucagaaugcucagucggcauacuacauuacgaaaaacuaucaaaaauaggucucgucaaagggauuacaagaaaauacaaaauaaaaucaaacccccuaacaaaagacauagucauaaaaaugauaccaaacguaucaaauaugucacaauguacaggaagcguaauggaaaacuacaaaacacgacuuaacggaaucuuaacaccuauaaaaggagcuuuagaaauauacaaaaauaacacacacgaucuaguaggagauguucgacucgcaggagucauaauggcaggcguagccauagguauagcaaccgccgcacaaauuaccgcaggaguagccuuauacgaagcaaugaaaaacgccgauaacauaaacaaacuaaaaucauccaucgaaucaaccaacgaagcagucguaaaacuacaagaaaccgccgaaaaaacagucuauguccuaacagcauuacaagacuacauaaauaccaaucuuguuccaacaauagauaaaauuucaugcaaacaaacagaacuaucucucgaccuagcauuaucaaaauacuuauccgaccuacuauucguauuuggacccaaccuacaagaucccgucucuaacucuaugacaauccaagcaaucucacaagccuucggaggaaauuacgaaacauuacuaagaacacucggauaugcaacagaagacuucgacgaucuacuagaaagcgauuccauaaccggacaaauaauauacgucgaucuauccggauauuacaucauaguuagaguauauuucccaauauuaacagaaauacaacaagcauacauacaagaacuacuccccgucucuuuuaacaacgauaacuccgaauggauaucaauugucccaaacuucauacuaguccgcaauacacuaauuuccaauauagaaauagguuucugucucaucacaaaaagaucagucauaugcaaccaagacuaugcaacacccaugacaaauaacaugagagaaugccuaaccggcucaaccgaaaaaugcccacgagaacuaguuguaucuucacaugucccccgcuucgcacucucuaacggaguauuauucgcaaacugcauaucaguaacuugccaaugucaaacaacaggcagagccauaucacaaucuggagaacaaacacuauuaaugaucgacaauacaacauguccaacagcaguccuaggaaacguaauaauaucacuaggcaaauaccuaggaucaguaaacuacaacuccgaaggaaucgcaauaggaccccccgucuuuacagacaaagucgacauauccucacaaauauccucaaugaaucaaucucuacaacaauccaaagacuacauuaaagaagcacaaagacuauuagauacaguuaacccaucccucauauccauguuaucaaugauaauacuauauguccuaucaaucgcaucccucuguaucggauuaaucacauucauaucauuuauuauaguagaaaaaaaacgaaacaccuacuccagacuugaagaucgacgaguaagaccaaccucaucaggcgauuuauauuacauuggaacauaa

SEQ ID NO: 185 - RNA, 1641 nt, Artificial Sequence
  derived and/or modified CDS sequence (opt6) from Nipah henipavirus__AAY43915__F
auggcaguaauacuaaauaagagauacuacucaaaccuacuaauacuaaucuuaaugaucucagaauguuccguaggaauacuccacuaugaaaaauuaucaaaaauaggauuagucaaaggaauaacaagaaaauauaaaaucaaaucaaauccccuaacaaaagauaucguaauuaaaaugauaccaaauguaucaaauaugagucaaugcaccggaagcguaauggaaaauuauaaaacacgcuuaaacggaauacuaaccccaaucaaaggagcuuuagaaauuuauaaaaacaacacacaugauuuaguaggcgauguaagacuagcaggcguaauuauggcuggcguugcaauaggaauagcuacagcugcccaaauaaccgcuggagucgcacucuaugaagcaaugaaaaacgcugacaacauaaauaaacuaaaaucaucaauagaaagcaccaaugaagccgucguaaaacuacaagaaacagcagaaaaaacaguauacguauuaaccgcuuuacaagacuauauaaauacuaacuuaguccccacaauugacaaaauuuccugcaaacagacagaacuaucacucgauuuagcauuaucaaaauacucuuccgacuuacuauucguauucgguccuaaucuacaagacccagucuccaacuccaugacuauccaagcaauaucccaagcauuuggaggaaauuaugaaacacucuuaagaacccucggauacgcaacagaaggcuucgaugaccuacucgaauccgacaguaucacaggacaaauaauauauguagacuuaucuggauacuauauaauaguaagaguauacuuuccaauucuaacagaaauacaacaagccuacauccaagaacuauuaccuguuucauuuaacaaugacaacuccgaauggauaucaauaguacccaauuucauccuuguuaggaacacccuaauauccaacauugaaaucggauuuuguuuaauaaccaaacgaucagucaucugcaaccaagauuaugcaacaccaaugaccaacaacaugagagaaugccuaacaggaucaacagaaaaauguccacgagaacuaguagucucaucccauguaccaagauucgccuuaucuaacgguguacuauucgcaaacugcaucaguguuaccugccaaugucaaaccacaggcagagccauaucucaaucuggagaacaaacacuacucaugauagacaauacaacuuguccaaccgcaguauuaggcaacguuauaauaucauuaggaaaauaccuaggaagugucaacuauaacucagaaggaauugcuauaggaccacccguauucacagauaaaguagacauauccucacaaauaucauccaugaaccaaucauuacaacaaucuaaagauuacauaaaagaagcacaaagacuauuagacacaguaaauccaucauuaauaucuaugcuaucaaugauaauacuauauguccucucaauugcuucacuuugcauaggccuaauaaccuuuaucucauucauaauaguagaaaaaaaacgaaacacauacuccagacuagaagacagacgaguuagacccacauccucaggugaccuauauuacauaggaacauaa

SEQ ID NO: 186 - RNA, 1641 nt, Artificial Sequence
  derived and/or modified CDS sequence (opt6) from Nipah henipavirus__CAF25496__F
auggucguaauccucgacaaaagaugcuacuguaaccuauuaauuuuaauucuaaugauauccgaaugcucgguaggaaucuuacauuaugaaaaacuaucaaaaauuggauuaguaaaagguguaacacgaaaauacaaaaucaaaucaaacccucuaacaaaagauauagucauaaaaaugauccccaacguaucaaacaugucacaauguaccggaucaguaauggaaaacuauaaaacgagauuaaacggaauucuaaccccaauaaaaggugcucuugaaauauauaaaaacaacacacacgaccuagucggagacguaagacuagcuggcguaauaauggccgguguagcaauaggaauagcaacagccgcacaaauaacagcuggcgucgcccuauacgaagcaaugaaaaaugcagacaacauuaacaaacuaaaaucaucaauagaauccacaaacgaagccguaguaaaauuacaagaaaccgcagaaaaaacaguauauguauuaaccgcacuucaagacuacauaaacaccaaucucguaccaacaauagacaaaauaucuuguaaacaaacagaacuaucacuagaucuagcauuaagcaaauacuuaucagacuuacucuucguauuuggaccaaaccuacaagaccccguaucaaacucaaugacaauacaagccauaucacaagcauuuggaggaaacuacgaaacacuauuaagaacacucggcuaugccauagaagacuucgacgaucuauuagaaucagauucaauaacaggccaaauaauauauguagaccucaguucauauuacaucauaguccgaguuuacuucccaauccuaacagaaauacaacaagcauacauacaagaacuacuaccaguauccuucaacaacgacaacucugaauggauaucaauagucccuaauuuuauacuaguaagaaacacauuaauaagcaacauagaaauaggauucugccuaauaacaaaaagauccguuauauguaaccaagacuacgcaacccccaugacaaacaacaugagagaaugucuaacaggcucaaccgaaaaauguccuagagaauuagucguaucaucacauguaccaagauucgcacuaucaaauggaguacucuucgcaaauuguaucucaguuaccugccaaugccaaaccaccggaagagcaauaucacaaucuggagaacaaacauuacuaaugaucgauaacacuacuugucccacagcaguucuuggaaacgucaucauaucacuaggaaaauaccuaggcucaguaaacuacaauagcgaagguauagccauuggaccaccaguuuuuacugacaaaguagacaucucaagucaaauaucaucaaugaaccaaagcuuacaacaaucuaaagauuauauaaaagaagcacaaaggcuacuagacaccgucaacccaucauuaauaagcaugcuaucaaugauaauuuuauauguauuauccaucgcuucucuaugcauaggccuaauaaccuucauaagcuucauuauuguugaaaaaaaaagaaauacauacucacgacuagaagacagaagaguccgaccaacauccucaggagauuuauauuauauaggaaccuaa

SEQ ID NO: 187 - RNA, 1641 nt, Artificial Sequence
  derived and/or modified CDS sequence (opt6) from Nipah henipavirus__AAM13405__F
auggucguaauacucgacaaaagaugcuacuguaaccuucuaauacuaauacucaugauaucagaaugcucaguaggcauacuccauuacgaaaaacuaucaaaaauaggcuuaguuaaaggaguaacaagaaaauacaaaauaaaaucaaauccacuaacuaaagauauaguaaucaaaaugauacccaacguaucaaauaugucacaauguacuggaucaguuauggaaaauuacaaaacaagauuaaacggaauucucacacccauaaaaggagcacuagaaauuuacaaaaauaacacucacgaccuagucggcgacguaagauuagcagguguaaucauggcagguguagccaucggcauagcaacagcagcccaaauaaccgccggcguugcuuuauaugaagcaaugaaaaacgcagauaauauaaacaaauuaaaaucaucaauagaaucaacaaacgaagcuguaguaaaacuucaagaaacagcagaaaaaacaguauacguacuaacagcuuuacaagacuacaucaacacaaaccuaguaccaacgauagacaaaauaucaugcaaacaaacagaacuaucuuuagaucuagcauuaucaaaauaucuaagcgaccuucucuucguguucggucccaaccuacaagacccagucucaaacucuaugacaauacaagcaauaucacaagcauucggaggcaacuaugaaacacuacucagaacacucggcuaugccacagaagacuucgacgauuuacuagaaucagacuccauaaccggacaaauuaucuacguagaccucucgucuuacuacauaauaguaagagucuauuuccccauauuaacagaaauccaacaagcauacauacaagaacuucuaccaguaucauucaauaacgacaacucagaauggauaucaauagucccaaauuucauacuaguacguaauaccuuaaucucaaauauagaaauaggauucuguuuaaucacaaaaagaucaguaauaugcaaccaagacuacgccacaccaacgacaaacaacaugcgcgaaugucucacuggaucuacagaaaaaugccccagagaacuaguaguaucuucccacguaccacgauucgcacuguccaauggaguauuauucgcaaacugcauaagcguaacuugccaaugccaaacuaccggccgcgcaauaucacaaucaggcgaacaaacucucuuaaugauagauaauaccacaugccccaccgccguacuaggcaauguaaucaucucauuagguaaauaccuaggaucagugaacuacaacucagaagguauagcaauugguccaccaguauuuacugacaaaguagacaucagcucacaaauauccucaaugaaucaaucauuacaacaaucaaaagacuauaucaaagaagcacaaagacucuuagacacaguaaacccaagcuuaauuagcaugcuauccaugaucauacucuauguacuuucaauagcaucccuuugcaucggacuaauaacuuuuaucucauucaucaucguagaaaaaaaacgaaacacuuacucaagacuagaagauagaagaguaagacccacaucaaguggagacuuauauuauauaggaacauaa

SEQ ID NO: 188 - RNA, 1641 nt, Artificial Sequence
  derived and/or modified CDS sequence (opt6) from Nipah henipavirus__CBM41033__F
augguaguaauacucgacaaaagaugcuacuccaaccuacucauacuaauuuuaaugauaucagaauguucuguaggaauacuccauuacgaaaaacuuucaaaaauaggcuuaguaaaaggaguaacaagaaaauauaaaauaaaaucaaacccccuaacuaaagauauaguaauaaaaaugaucgcaaacguuucuaacaugucccaauguacaggaucaguaauggagaacuauaaaacaagauuaaauggaauauuaacaccaaucaaaggcgcacucgaaauauacaaaaacaacacacacgacuugguaggugauguacgacuagcaggagucaucauggccggcguagcaauaggaauagcuacagcagcacaaauaacagcaggaguagcauuauacgaagcaaugaaaaaugccgauaacauaaacaaauuaaaaucaucuauagaaucaacaaaugaagccguaguaaaacuacaagaaacagccgaaaaaacaguuuacguucuuacagccuuacaagauuauaucaauacaaauuuaguaccuacuaucgauaaaauauccugcaaacaaacagaacucucacucgaccuagcccucucuaaauaccuuucugauuuauuauucguauucggaccaaacuuacaagaucccguuucaaauuccaugacuauacaagcaauaagccaagcauuuggaggaaacuacgaaacacuucuaagaacauuagguuacgcaacugaagacuuugacgaccuacuagaaucagacucaaucacaggacaaaucaucuacguagacuuaucuucauacuacauaaucguccgaguauacuucccaauauuaacagaaauucaacaagccuauauacaagaacuacucccaguauccuuuaauaaugacaacucagaauggauaucaauagucccuaacuucauacuaguaagaaacaccuuaauuucaaacaucgaaauaggcuucugccuaauaaccaaacgaucaguaauaugcaaccaagacuacgcaacuccaaugacaaauaauaugcgagaauguuuaacaggaaguacagaaaaaugccccagagaauuagucguaucaucucaugucccaagauucgcacuaucaaauggaguacuauucgcaaacugcauaucaguaacaugucaaugucaaacuacuggccgugcaauaucucaaucaggagaacaaaccuuacucaugauagacaacacaaccugcccaacagcuguacuuggcaacguaauaaucucacuaggaaaauaccuaggaaguguaaacuauaacucugaggggauagcaauaggcccaccaguauucacagauaaaguagacauuagcucccaaaaaucaucuaugaaucaaucacuccaacaaucaaaagacuacauaaaagaagcacaacgcuuauuagacacaguaaauccaucacuaauaucaaugcuaucaaugauaauauuauacgucuuauccauagccagcuuauguauaggcuuaauaaccuucauauccuucauaaucguagaaaaaaaacgcaauaccuacucacgacucgaagacagacgaguaagaccaaccuccuccggagaccuauacuauaucggcacauaa

SEQ ID NO: 189 - RNA, 1641 nt, Artificial Sequence
  derived and/or modified CDS sequence (opt6) from Nipah henipavirus__AEZ01396__F
auggcaguaauucuaaacaaaagauacuauucaaacuuauuaauacuaauacuaaugauaucagaaugcucagucgguaucuuacacuacgaaaaacucuccaaaauaggccuaguaaaaggcauaacacgaaaauauaaaauaaaaucuaacccacuaacaaaagacaucguaauaaaaaugaucccaaacguauccaacaugucacaaugcacaggcucaguaauggaaaauuacaaaaccagacuaaauggcauuuuaacaccaauaaaaggagcacuagaaauuuacaaaaacaacacacacgaccuagucggagauguacgacuagccggagucauaauggcaggaguagcaauaggaauagccaccgcagcucaaauaacagcaggagucgcccuauaugaagccaugaaaaaugcugauaauauaaacaaauuaaaaucuucaaucgaaucaacaaacgaagcaguagucaaacuacaagaaacagcagaaaaaacagucuauguacuaacagcccuacaagacuacauaaacacaaauuuagucccuaccauagauaaaauaagcuguaaacaaacagaacucucacuagaccuagcccucucaaaauaccucucagaccuauuauuuguauucggacccaaccuccaagacccagucucuaacucuaugacaauacaagcgauaucccaagcauucggcgguaauuacgaaacauuacugcguacacuuggcuacgcaacagaagacuuugacgacuuauuagaaucagauucaauaaccggacaaauaauauacguagacuuauccggcuacuacauaauagucagaguauauuucccaauauuaaccgaaauccaacaagccuacauacaagaacuacuaccaguuucauucaacaaugauaacucugaauggaucucuaucguuccaaacuuuauuuuagugagaaacacccuaauaucaaacauugaaauaggcuucuguuuaauaacuaaaagaucaguuauaugcaaccaagacuacgcaacacccaugacaaauaacaugagagaaugccuaaccggcucaaccgaaaaaugcccacgagaauuagucguaucaucacacguaccacgcuucgcacucucaaauggaguccuuuucgcaaacugcauaucagucacuugucaaugccaaaccacaggcagagccauaucccaaucaggcgaacaaacccuacucaugauagacaauacaacauguccaacagcuguccucggcaauguuauaauaucccucggcaaauauuuagguucuguaaacuacaacucagaaggaauagcuaucggaccucccguauuuacagacaaaguagacaucucaucucaaauaucaucaaugaaccaaucccuacaacaaaguaaagacuacauaaaagaggcacaaagacuacuagacaccguaaacccguccuuaaucucuauguuaagcaugaucauacuauacguauuaucaauugcaucauuaugcauaggauuaauaacauucauuucauucauaauaguagaaaaaaaacgaaacaccuauucacgauuagaagaucgaagaguacgaccaacuagcuccggcgaccuauauuacaucggaacauaa

SEQ ID NO: 190 - RNA, 1641 nt, Artificial Sequence
  derived and/or modified CDS sequence (opt6) from Hendra henipavirus__NP_047111__F
auggccacccaagaaguucgacuaaaauguuuacuaugcggaauaauaguccuaguacucucucuagaaggauuaggaauccuacacuacgaaaaacuaucaaaaaucggccuagucaaaggaauaacacguaaauacaaaauuaaaucuaacccacuaaccaaagacauaguaauaaaaaugauuccaaacguuagcaacgucucaaaaugcacaggaacagugauggaaaacuauaaaucaagacuaacaggaauacuaucccccauaaaaggugcaaucgaauuauacaacaacaauacccaugaucuaguaggagauguaaaauuagcuggaguugucauggccggcauagcaauaggaauugcaacagcagcccaaauaacagccggaguagcucuauaugaagcaaugaaaaacgccgauaauauaaacaaacuaaaaucgucaauagaaucaacuaaugaagcaguugucaaacuacaagaaacagcagagaaaacaguauacguccucacagcuuuacaagauuauauaaacacaaacuugguacccacaauagaucaaauaucuuguaaacaaaccgaacuagcacuagaccuagcacuguccaaauaccucucagaucuucuauucguauucggcccuaaccuacaagaccccguuucaaacucuaugacaauucaagcaauaucacaagccuucggaggaaacuacgaaacacuacucaggacacucgguuaugcaacagaagacuuugaugaucuucuugaaucagauucaauagcaggucaaauuguauacguagauuuauccucauacuacauaauaguaagagucuacuucccaauauuaacugaaauucaacaagcauacgugcaagaauuacuaccaguaucauucaacaacgauaacucagaauggauaaguauaguaccaaauuucguacucauaagaaauacucuaauaucaaacauagaagucaaauauugcuuaauuacaaagaaauccguaaucuguaaccaagacuacgcaacccccaugacagcaucugucagagaaugucucaccggaucaacagauaaaugcccacgagaauuaguaguauccucacacguaccuagauucgcauuaucaggcggaguccuauucgcaaauugcauaucuguaacaugccaaugccaaacaacaggacgugcaauaucccaaucaggagaacaaacacuauuaaugauagacaauacuaccuguacaaccguaguacucgguaacauaauaauaagucuaggaaaauauuugggaaguauaaacuacaauucagaaucaauagcaguaggaccacccguauacacagauaaaguagacauauccucacaaauuucaucgaugaaucaaucacuccaacaauccaaagacuacaucaaagaagcacagaaaauacuagacacaguaaaccccucacuuauauccauguuauccaugauaauucuauacguucucuccaucgcagcccuaugcauaggauuaauaacuuucauuucauucgucauaguagaaaagaaaagaggaaacuauaguagauuagaugacagacaagucagaccagucucaaacggcgauuuauacuacauaggcacauaa

SEQ ID NO: 191 - RNA, 1641 nt, Artificial Sequence
  derived and/or modified CDS sequence (opt6) from Hendra henipavirus__AEB21233__F
auggccacacaagaaguaagauuaaaauguuuacuaugcggaauaauaguccuaguuuuaucccuagaaggauuaggaauacuacauuaugaaaaauuauccaaaauaggauuaguaaaaggaauuacaagaaaauacaaaauaaaaagcaauccucuaacaaaagacauaguaauaaaaaugauccccaauguaucuaacguaucaaaaugcacaggaacagucauggaaaauuacaaaucaagacuaacuggaauucuaucaccaauuaaaggcgcuauagaacuauacaauaauaacacacacgaucuuguaggcgacguaaaguuagcgggaguuguaauggcaggaauugccauagguaucgcaacagcagcccaaauaaccgcaggcguagcacuauacgaagccaugaaaaaugcagauaacauaaauaaauuaaaauccaguauugagucaacaaaugaagcaguaguaaaacuccaagaaacagcagaaaaaacagucuauguacucacagcccuucaagauuacaucaauacaaaccuaguaccaacaauagaccaaauaucauguaaacaaaccgaauuagcacuagaccuagcacuuucaaaauacuuaagugaccuuuuauuugucuucggccccaaccuacaagacccaguauccaacaguaugacaauacaagccauaagucaagcauucggagguaacuacgaaacccuccuaagaacccuaggauacgcaacagaagacuuugacgaccucuuagaaagcgauucaaucacaggacaaauaguuuacgucgacuuaucuaguuacuacauaauaguaagaguauacuuccccauucuaacugaaauucaacaagcauacguacaagaauuacuaccaguaucauucaacaacgacaacucagaauggaucucaauaguuccaaacuuuguacuaauucgaaauacacuaaucucaaauauagaaguaaaauacugccuuauaacaaaaaaauccguaauaugcaaccaagacuaugcaacaccaaugaccgcaucaguucgagaaugccucaccgguuccacagauaaauguccaagagaauuaguaguaucuucacacguaccaagauucgcuuuaucaggaggcguucuauuugcaaacugcaucagcgucacaugccaaugucaaacaacuggccgagcaauaucacaaucuggagaacaaacacucuuaaugauagacaacacuaccugcacaacaguaguacucggaaacaucauaauaucacuuggaaaauaccucggaucaauuaacuauaacagugaaucaaucgcuguuggucccccaguauauacagacaaagucgacaucagcucacaaauuucaucaaugaaccaaucacuucaacaaucaaaagauuauauaaaagaagcacaaaaaauacuagacacaguaaacccaucuuuaauuucaauguuaucaaugauaauauuauauguucuaucaauugccgcacuaugcauuggauuaauaaccuuuauaucuuuuguaauaguugaaaaaaaaagagguaauuauucucgccuugacgaucgccaaguacgcccaguauccaacggugaccucuauuauauuggaaccuaa

SEQ ID NO: 192 - RNA, 1641 nt, Artificial Sequence
  derived and/or modified CDS sequence (opt6) from Hendra henipavirus__AEQ38114__F
auggcaacacaagaaguacgacucaaaugccuauuaugcggaauaauaguauuaguacuaucccuagaaggacuaggaauucuacauuacgaaaaacuuagcaaaauaggacuaguaaaaggaauaacccgaaaauacaaaauaaaaucaaacccccuaacaaaagacauaguaauaaaaaugauaccaaaugucucaaacgucagcaaaugcacaggcaccgucauggaaaauuacaaaucacgacuaacaggaauauuaucaccaauaaaaggagcaaucgaacuauacaacaacaacacacacgaucuaguaggcgacguaaaacuagcaggaguagucauggccggaauagcaauaggaaucgcaacagcagcucaaauaacagcaggaguagcacuuuacgaagcuaugaaaaacgcagacaauauaaacaaacuaaaaucaucaaucgaaucaacaaacgaagcuguuguaaaauuacaagaaacagcugaaaaaacuguauacguccuaacagcccuccaagauuacaucaacacaaacuuagucccaacaauugaucaaauuucaugcaaacaaacagaacuagcucuagaucuagcccuaucaaaauaccuaucugaccuacuauuuguauucggucccaauuuacaagaucccguaucaaauucaaugacaauacaagcaauuagccaggcuuucggaggaaauuaugaaacacuacuacgcacacuaggauacgcgacagaagacuuugacgacuuauuagaaucugauucaauaaccggucaaaucguauauguagacuuaagcucuuacuacaucauaguuagaguauacuucccaauccucacagaaauacaacaagccuacguccaagaauuauuaccaguaucuuucaacaacgacaacucagaauggauaucaauaguuccaaacuucguuuuaauaagaaacacacuaaucucaaauauagaagucaaauacugcuuaauaaccaaaaaaucaguaauaugcaaccaagauuacgccacaccaaugaccgcuucaguacgagaaugccuaacaggaucaacagauaaaugccccagagaauuaguuguaucaucccacguuccaagauucgcacuaucaggaggaguacuuuucgcaaauugcauaucaguuacuugccaaugccaaacaaccggacgcgcaauuucucaauccggagaacaaacacuacuaaugaucgacaacacaaccugcacaacaguaguacuaggaaauauuauaaucucacuaggcaaauacuuagguucuauaaacuauaacagugaaucaauagcuguaggaccaccaguauacacagacaaagucgacauuucuucacaaauuucuucaaugaaucaauccuuacaacaaaguaaagacuauauaaaagaggcacaaaaaauacuugacaccguaaaucccucacuuauaucaauguuaucaaugaucauccucuacguacuaucaaucgcagccuuaugcauaggacuaauaacauuuauuucauuuauaauaguagaaaaaaaacgaggcaauuacaguagacuagacgacagacaaguacgaccuguaucaaauggugaccucuacuacauaggaacauaa

SEQ ID NO: 193 - RNA, 1641 nt, Artificial Sequence
  derived and/or modified CDS sequence (opt6) from Hendra henipavirus__AAB39505__F
auggccacacaagaaguaagacuuaaaugccuauuaugcggcauaauagucuuaguccuaucacucgaaggcuuaggaauacuacacuacgaaaaauuaaguaaaaucggccuagucaaaggaauuacccgaaaauacaaaaucaaaucuaacccauuaaccaaagacauagucauaaaaaugauuccaaacgucucaaacguaucaaaaugcacuggaaccguaauggaaaacuauaaaucacgauuaaccggaauacuaucaccaauuaaaggagcaaucgaacuuuauaacaauaacacacacgaccuaguuggcgacguaaaacuugcagguguaguaauggcagguaucgccaucggaauagcaacugcagcucaaaucacagccggaguagcucucuacgaagccaugaaaaacgcagacaauauaaacaaauuaaaaucaagcauagaaucaaccaacgaagcaguuguuaaacuucaagaaaccgcugaaaaaaccguauauguucuaacagcacuacaagacuauauaaacacaaaccuaguacccacaaucgaucaaauuuccugcaaacaaaccgaacuagcccuugaucuugcacucagcaaauauuuacucauauguucauguuucggcccaaaucuacaagauccaguauccaauucaaugaccauacaagcaaucucacaagcauuuggagguaacuacgaaacacuccuaagaacauuaggcuacgcuacagaagauuucgaugaccuccucgaaucagacuccauaacaggacaaauaguauacgucgaccuaucauccuacuacauaauagucagagucuacuucccaauacuaacagaaauucaacaagcauauguacaagaacuacuaccugucucauucaacaacgacaacucugaauggauauccauaguccccaauuuuguccuaauaagaaacacacuaaucucaaacauagaaguuaaauauugcuuaauaaccaaaaaaucagucauauguaaccaagacuacgcaacaccaaugaccgcaucaguaagagaauguuuaacagguaguacagacaaauguccaagagaauuaguaguuagcucccacguaccaagauuugcacuaucaggcggcguacuauucgcuaacugcauaaguguaacaugucaaugccaaaccacugggcgagcaaucucacaaucucgagaacaaacacuucuaaugauagacaacacaacaugcaccacaguaguucuaggcaauaucauaaucucacuaccaaaauacuuaggauccauaaaacuucaaguacuaagagcuuuacuccucggccaccaaucaauccaaaccaaaguugacauaucuucacaaauaucaucaaugaaucaauccuuacaacaauccaaagacuauaucaaagaagcacaaaaaauuuuagauacuguuaaccccaguuuaauaucuaugcuaucaaugauuauauuauacguccucaguauagcagcauuaugcauaggacucauaacauuuauaucauucguaauaguugaaaaaaaacgaggaaauuacucaagacuugacgacagacaaguaagaccaguaucaaauggagauuuauacuacaucggcacuuaa

SEQ ID NO: 194 - RNA, 1809 nt, Artificial Sequence
  derived and/or modified CDS sequence (opt6) from Nipah henipavirus__AAK50554__G
augccagcagaaaauaaaaaaguacgauuugaaaacaccacauccgacaaaggaaaaauuccaucuaaaguaauuaaaucauauuacggaaccauggauauaaaaaaaauaaacgaaggacuauuagacucaaaaauacuaucagcauuuaauaccgucauagcccuacuaggaucaauaguaauaauaguaaugaacauuaugauaauccaaaacuauacacguucuaccgauaaucaagcuguaauuaaagacgcauuacaaggaauucaacaacaaauaaaaggccuugccgacaaaauaggcacagaaauuggcccaaaaguaucuuuaauugacaccucaaguaccauaaccauacccgcuaauauaggacuauuaggcucaaaaauaucacaaucaacugcaucaauuaaugaaaacguaaacgaaaaaugcaaauuuacacuaccaccucuaaaaauccaugaaugcaacauaucuugcccaaaccccuuaccauuuagagaauaccgcccacaaacagaaggcguaucaaaccuaguaggccuacccaacaacauaugccuacaaaaaacaucuaaccaaauuuuaaaaccaaaauuaauaucuuacacauuaccagucgucggacaaagcggaaccugcauuacagacccacuacuagcaauggacgaaggauacuucgcauauucacaucuagaacguauaggaucauguucacguggugucucaaaacaacgaauaauaggaguaggcgaaguauuagaucgaggagacgaaguuccguccuuauucaugacaaaugucuggaccccaccaaaccccaacacaguguaccacugcucagcaguuuacaauaacgaauuuuauuacguacuaugcgcaguuucaacagucggagacccaauacuaaacaguacauauuggagcggaucauuaaugaugacaaggcucgccgucaaaccaaagagcaacggugguggauacaaucaacaccaacuagcacuaagaucaauagaaaaaggaagauacgacaaaguaaugccauacggcccaucaggaaucaaacaaggagauacauuauacuucccagcagucgguuuucuaguaagaacagaauuuaaauacaacgauucaaauuguccaaucacaaaaugccaauauucaaaaccagaaaacugcagacuaucgaugggaauacgcccaaacucccacuacauacuuagaucuggacuauuaaaauacaauuuaagcgauggagaaaacccaaaaguagucuucauugaaauaucagaccaaagacuaucaauaggaucaccaucaaaaauauaugacucacuaggacaaccaguauucuaccaagcuucauucucaugggauacaaugauuaaauuuggagauguauuaaccguaaaucccuuaguaguaaauuggagaaauaacacuguaauuucuagaccaggacaaagccaauguccgagauucaauacaugucccgaaauaugcugggaaggaguauacaaugacgcauuccuaaucgaucgaaucaacuggauaagugcaggcguauuccuagacucaaaucaaacagcagaaaacccagucuucacaguauucaaagacaaugaaauacucuauagagcacaacucgcuucagaagacacuaaugcacaaaaaacaauaacaaacuguuuuuuacucaagaacaaaaucuggugcauuucauuaguagaaaucuacgacacaggagacaaugucauuagaccaaaacuauucgcagucaaaauaccagaacaauguacauaa

SEQ ID NO: 195 - RNA, 1809 nt, Artificial Sequence
  derived and/or modified CDS sequence (opt6) from Nipah henipavirus__AEZ01389__G
augccaacugagucuaaaaaaguacgcuuugaaaacaccgcaucagacaaaggcaaaaauccauccaaaguuauaaaaucauacuauggaacuauggauauaaaaaaaaucaaugaaggacuucuugacucaaaaauacucucugcauucaauacaguaaucgcccuacuggguuccauaguaauaauugucaugaacauaaugauuauacaaaauuacacaagaucaacagacaaucaagccaugauaaaagacgcucuacaaagcauucaacaacaaauuaaaggcuuggcagacaaaauaggcacagaaauaggcccaaaaguaagcuuaauagacaccucuaguacaauuacaauacccgcaaauauaggguuauuaggaucaaaaauaagccaaaguacagccuccauaaacgaaaauguaaacgaaaaaugcaaauuuacucuaccaccacuaaaaauacaugaauguaauauauccugcccaaacccacucccauucagagaauacaaaccacaaacagaggguguaucaaauuuaguaggauuaccuaacaauauaugucuacaaaaaaccuccaaccaaauacuuaaaccuaaacuaauaucauacacacucccaguaguaggacaaagcggaacauguauaacagacccacuccuagcaauggacgaaggauacuuugcauauagucaccuagaaaaaauaggaucauguagccgaggcgucaguaaacaaagaauaauaggaguaggagaaguacuagaccgaggagaugaaguaccuucacuauuuaugacaaacguauggacuccuucaaacccaaauacaguauaucacugcucagccgucuacaacaaugaauucuacuacguguuaugcgcaguaucaguaguaggagauccaauauuaaacagcacauauuggucaggaucuuuaaugaugacaaggcuagcagucaaacccaagaacaacggagaaucauauaaccaacaccaauucgcacuaagaaacauagaaaaaggaaaauacgacaaaguaaugccauacggaccaucagguauuaaacaaggagacacccuuuacuucccagcagucggguuucuaguaagaacagaauuuaaauauaaugacucaaauugcccaauagcagaaugucaauauuccaagccagaaaauugccgacucuccaugggaauaagaccuaacucacauuacauucuaagauccggacuucuaaaauacaauuuaucagaugaagaaaauaguaaaauaguauucauagaaauuagcgaucaacggcuuucaauaggaucaccaucaaaaaucuacgauucauuaggccaacccguuuuuuaucaagcaucauucuccugggacacaaugauaaaauuuggagacguacaaacuguaaacccacuaguaguaaauuggagagacaacacaguaauaucacgacccggucaaucccaaugcccucgauuuaacaaaugcccagaaguaugcugggaaggaguauacaacgacgcauuucuuauugaccgcauaaacuggauaucagcaggugucuuccuagauucaaaccaaacugcugaaaaccccguauucacaguauucaaagacaacgaaguacucuacagagcucaacuagcaucugaagauacaaacgcacaaaaaaccauaacaaacugcuucuuauuaaaaaacaaaaucuggugcaucucacuaguagaaauauacgauacaggagacaaugucauaagaccaaaacuauucgcaguaaaaauccccgaacaaugcacauaa

SEQ ID NO: 196 - RNA, 1809 nt, Artificial Sequence
  derived and/or modified CDS sequence (opt6) from Nipah henipavirus__ACT32615__G
augccaacagaauccaaaaaaguaagauucgaaaacacugcaucugacaaaggaaaaaacccaucaaaagucauuaaaucauacuacggaaccauggacaucaaaaaaauaaaugaaggcuuauuagacagcaaaaucuuaucagcauucaacacaguaaucgcacuauuaggaagcauagucauaauuguaaugaauaucaugauaauacaaaacuauacaagaucaacagacaaucaagccaugauaaaagacgcuuuacaauccauccaacaacaaauaaaaggacuagcagauaaaaucggcacagaaauaggaccuaaaguaucucugauagauacuucaucaacaauaacuauaccagccaauauaggucuucuggguucaaaaauaucacaauccacugccuccaucaacgaaaacguaaaugaaaaaugcaaauuuaccuuacccccauuaaaaauacacgaaugcaacauaucauguccaaacccacuaccauucagagaauauaaaccucaaacagaaggagucucaaaccuaguuggcuuaccaaauaacaucugccuacaaaaaacauccaaccaaauauuaaaacccaaacuaauuucauacacacuuccaguaguaggacaauccggaacuuguauaacagaccccuuacucgcaauggacgaaggauacuuugcauauucccaccucgaaaaaaucggaucuugcucacgaggcguaucaaaacaacgaauuauaggaguaggagaaguauuagacagaggugaugaagucccaucauuauuuaugacaaacguauggacuccaagcaacccaaacacaguauaucacuguuccgccgucuacaauaacgaauucuacuaugucuuaugcgcuguaucaguaguaggugaccccguucuaaacucaacauacuggucuggcucacuaaugaugacaaggcuagccguaaaaccaaaaaauaacggagaaucauauaaucaacaccaauucgcacuaagaaacauagaaaaaggaaaauacgacaaagucaugccuuacggcccuuccggaauaaagcaaggagacacacuauauuuuccagccguagguuucuuaguacgaacugaauuuaaauauaacgacucaaacugccccaucgcugaaugucaauauucaaaaccagaaaauugcagacuaucaaugggaauaagaccaaauucacacuacauacuaagaagcggacuccuuaaauacaacuuaucagaugaagaaaacucuaaaauagucuucauagaaauauccgaccaaagacuauccauaggaucaccaucaaaaauauacgacucacuaggucaaccaguauucuaccaagccagcuucucaugggacaccaugauuaaauucggugauguacaaacagucaauccccuaguugucaacuggcgagacaauacaguaauauccagaccaggacaaucucaaugccccagauucaacaaaugucccgaaguauguugggaaggaguuuauaacgacgccuuucuaauagacagaaucaacuggauuucugcuggcgucuuccuagauucaaaccaaacagcagaaaacccaguauuuacuguauucaaagacaaugaaguacuauaccgugcacaauuagcaucugaagacacaaacgcacaaaaaacaaucacaaacugcuuucuacuaaaaaauaaaauauggugcauaucacuagucgaaauauacgacacaggcgacaacgucaucagaccuaaacuauucgcugucaaaauacccgaacaauguacauaa

SEQ ID NO: 197 - RNA, 1809 nt, Artificial Sequence
  derived and/or modified CDS sequence (opt6) from Nipah henipavirus__CAF25497__G
augccugccgaaaacaaaaaagucagauucgaaaacaccacaucagacaaaggaaaaaaucccuccaaaguaauaaaaucauacuacggaacaauggacauaaaaaagaucaacgaaggauugcuagacagcaaaauccuaucagcauucaacacaguaauagcauuacuaggaucaauagucaucauaguaaugaauaucaugauaauccaaaauuauaccagaucuacagauaaucaagcaguuauaaaagaugcacuucaaggaauacaacaacaaauaaaaggucuagcagacaaaauaggaaccgaaauaggaccgaaagucucacuaauagacacuucaucaacuaucacaauaccagcaaauauaggccuacuaggaucaaaaauaagucaaagcacagcaucaauaaaugaaaauguaaacgaaaaaugcaaauuuacacucccaccccuaaaaauacaugaauguaacauaucaugcccaaacccacuacccuuucgagaauaccgcccucagacagaaggcgucuccaaccucguaggauuaccaaacaauauaugccuccaaaaaacuagcaaucaaauucuaaaaccaaaacuaauaucuuacacauuaccaguaguaggacaaucaggcacaugcauaacagacccacuuuuagcaauggacgaaggauacuucgcauauucacauuuagaacguauuggaucaugcucaagaggaguauccaaacaaagaauaauaggaguaggcgaaguccuagaccgaggcgaugaaguacccucccucuucaugacaaacgucugggcaccuccaaacccaaacacaguuuaucauugcuccgcaguauacaauaacgaauucuacuacguccuaugugcaguauccacagucggcgacccuauauuaaacuccacuuacuggagcggaucauuaaugaugaccagacuagccguaaaacccaaaaguaacggcgguggauauaaccaacaccaauuagcauuacguucaauagaaaaagggagauacgauaaaguaaugccauacgguccaucaggaauaaaacaaggagacacacuauacuuucccgcagucggcuucuuagucagaacagaauucaaauauaacgacucaaacugucccauaacaaaaugccaauauucaaaaccugaaaacugcagacuaucaaugggaauccgaccaaauucucacuacauccuuagaucaggcuuacugaaauauaaucucucagacggagaaaauccaaaaguaguauucaucgaaauaucagaucagagacuaucaauuggaucacccaguaaaauauacgacucucucggacaaccaguauuuuaccaagcuuccuucucaugggauacaaugauaaaauucggagacguacucacaguaaauccacucguaguaaacuggagaaauaauacaguuaucucacgucccggacaaucacaaugcccaagauucaacacauguccagaaauaugcugggaaggaguauacaaugaugcauuuuuaauagaccgaauaaauuggauaagugcaggaguauuuuuagacucaaaccaaacagcagaaaaccccguuuuuacaguauucaaagauaacgaaauauuauaccgugcccaacuagcaucugaagacacaaaugcacaaaagacuaucacuaauugcuuucuauuaaaaaacaaaauaugguguauaucuuuagucgaaauauacgauacaggagauaacguaauaagaccaaaacuguucgcaguaaaaauuccugaacaaugcacauaa

SEQ ID NO: 198 - RNA, 1809 nt, Artificial Sequence
  derived and/or modified CDS sequence (opt6) from Nipah henipavirus__CBM41034__G
augccagcagaaaauaagaaaguaagauuugaaaacacuacuagcgacaaaggaaaaaauccaucaaaaguaauaaaaagcuauuacggcacuauggacaucaaaaaaauuaaugaaggucuccuagauucaaaaauucuaucagcuuucaacacaguaauugcacuccuaggaucaauaguaaucaucguaaugaacaucaugauaauccaaaauuauacucgauccacagauaaccaagcugucauaaaagacgcauugcaagguauacaacaacaaauaaaaggucuagcugacaaaauuggaacagaaauaggaccaaaaguaucacugauagacacaucaucaaccauaaccauaccagcaaauauaggccuacuaggauccaaaauaucacaaagcaccgcauccauaaacgaaaacguaaacgaaaaaugcaaauuuacauuaccaccgcuaaaaauacaugaaugcaauauaucaugcccaaauccacuaccauucagagaauaccgaccacaaaccgaaggaguaagcaaucuaguaggacuaccagauaauauaugcuuacaaaaaacaucaaaucaaauccucaaaccaaaauuaauaucuuauacccuaccaguaguaggacaaagcgguaccugcauaacagacccacuacuagcuauggaugaaggauacuuugcuuacagccaccuagaacgaauaggaaguuguaguagaggaguaucaaaacaaagaauaauaggaguuggcgaagucuuagauagaggcgacgaaguaccaucacucuucaugacaaauguauggacacccccaaauccaaauacaguauaccacuguuccgcaguauacaauaaugaauucuacuacguauuaugcgcaguaagcacaguaggagauccaauacuaaauaguacauacuggucaggaucacuaaugaugacaagauuggcaguuaaaccaaaaucaaacggaggaggcuacaaucaacaccaacuagcacuaagaaguauagaaaaagguagauaugacaaaguaaugccauacggucccucaggaauaaaacaaggugacacacuauauuuuccagcagucggauuucucguaagaacagaauuuaaauauaaugauucaaacugcccaauuacaaaaugccaauauucaaaaccagaaaacuguagacuauccaugggaauaagaccaaacucucauuacauacuaagaucaggacuccucaaguauaacuuaucugauggagaaaaccccaaaauagucuuuauagaaaucucagaccaacgcuuaagcauagguucaccaucaaaaguauacgauagccuaggccaaccaguauuuuaccaagcaucauuuaguugggacacaaugauaaaauucggugauguucaaacaguaaaucccuuagucgucaauuggcgagauaacacaguaauaucuagacccggacaaagccaauguccacgauuuaacacauguccagaaauauguugggaaggcgucuauaacgacgcguucuuaauagacagaauaaacuggauaucagccggaguauuccuugacagcaaucaaacagcagaaaacccaguauuuacagucuucaaagauaaugaaauacuauaucgagcucaacuagcuagcgaagacacaaaugcacaaaaaaccauaaccaauugcuucuuacuaaaaaacaaaauauggugcauaucacuaguagaaauauacgauacgggagauaacgucauacgaccaaaacucuucgcaguaaaaauaccagaacaauguacauaa

SEQ ID NO: 199 - RNA, 1809 nt, Artificial Sequence
  derived and/or modified CDS sequence (opt6) from Nipah henipavirus__AAX51853__G
augccagccgaaaguaaaaaaguaagauuugaaaacacaacaucugauaaaggcaaaauaccauccaaaauaaucaaaagcuacuauggaacaauggacauuaaaaaaauaaacgaaggacucuuagacucaaaaauacucucagcauucaauacaguuauagcucuauuagguucaauaguaauaauaguaaugaauaucaugauuauacaaaacuacacaagaagcacugacaaucaagcaguaauuaaagacgcccuacaaggaauacaacaacaaauaaaaggacucgcagacaaaauagguacugaaauaggccccaaagucagucuaauagacaccucaucaacaaucacaauaccugcaaauaucggccuauuaggaucaaaaauaucacaaucaacugccucaaucaacgaaaacguaaacgaaaaauguaaguucacacuuccaccucucaaaauacacgaauguaauauaucaugccccaacccacuaccauuucgagaauacagaccucaaacagaaggaguuucuaaccuaguuggcuuaccaaauaacauaugucuucaaaaaacuuccaaucaaauacuaaaaccaaaacuaauaucauacacccuaccagucguuggccaaucaggaacauguauaacagauccacuauuagcaauggacgaaggauacuucgcauacucacaccuagaaagaauaggaucuuguucaagagguguaucaaaacaaaaaauaauaggaguaggagaaguucuagaccgaggagacgaaguaccaucgcuauucaugacaaaugucuggacaccacccaacccaaauacaguauaucacugcagugccguauacaacaaugaauuuuacuauguccuaugcgcagucucaacaguaggagacccaauccuaaacuccacauacuggucaggaagucuuaugaugacucgucucgcagucaaaccaaaguccaacgacggaggauauaaccaacaucaauuagcccuaagaagcauagaaaaaggaagauacgacaaagucaugccauacggccccucaggaauuaaacaaggagauacauuauauuucccagcaguaggauuucuaguacgaacagaauucaaauacaacgauucaaauugccccauaacaaaaugccaauacaguaaaccagaaaacugucgacuuagcaugggaauacgaccaaacucucacuauguacuaagaucuggccuccuaaaauauaaucuaucagacggugaaaaccccaaaauaguauucauagaaauauccgaccaaagauuauccauaggaucaccaucaaaaauauaugacuccuuaggucaaccagucuuuuaccaagcaucuuuuuccugggacacaaugauaaaauucggagauguacaaacaguaaacccucuaguuguaucuuggagagacaacacaguaauaucacgcccuggccaaucacaaugcccacgcuucaacacauguccagaaauaugcugggaaggcguauacaacgacgccuuucucauagacagaauaaacuggauaucagccggaguauuccuagacuccaaucaaacagcagaaaauccaguauuuacuguauucaaagauaacgaaauauuguacagagcacaacuagcaagugaagauaccaacgcccaaaaaacaaucaccaacugcuucuuauuaaaaaacaaaauauggugcaucucacuaguagaaauauaugauacaggcgacaauguaaucagaccaaaauuauucgcaguaaaaauacccgaacaaugcacauaa

SEQ ID NO: 200 - RNA, 1809 nt, Artificial Sequence
  derived and/or modified CDS sequence (opt6) from Nipah henipavirus__AEZ01397__G
augccaacagaaagcaaaaaaguucgauuugaaaacacagcaucugauaaaggcaaaaaucccucaaaaguaauaaaaaguuacuacggaacaauggacauaaaaaaaaucaaugaaggauuacucgacucaaaaauauuaucagcauucaauacaguaauagcccuacucggaucaaucgucauuauaguaaugaauaucaugauaauacaaaacuacacucguucaacagacaaucaagcaaugaucaaagacgcacuacaauccauucaacaacaaauaaaaggcuuagcagacaaaauuggcacagaaauaggaccaaaaguaucacuaauagacaccagcaguacaauaacaaucccugccaacauaggccuauuaggaucaaaaauaucacaauccacagcauccauaaaugaaaauguaaacgaaaaaugcaaauuuacacuaccaccacuaaagauucacgaaugcaauauaucuugcccaaauccacuaccauucagagaauauaaaccccaaaccgaaggagucuccaaucucgucggccuaccuaacaacaucugcuuacaaaaaacauccaaccaaauauuaaaacccaaauuaauaucauacacacuaccaguaguaggacaauccggaacaugcauuacagacccacuacucgccauggacgaaggauauuuugcauauucacacuuagaaaagauaggaucauguucaagaggagucucuaaacaaagaauaaucggcgucggugaaguccuagauagaggagaugaaguccccucgcuauucaugacaaacgucuggacaccaucaaauccuaauacaguauaccauuguucugcagucuauaacaacgaauucuacuaugucuuaugcgcaguaucaguagugggagacccaauccuaaacuccacauacuggucaggaagccuaaugaugacacgacuagcugugaaaccaaaaaauaacggugaaucauacaaccaacaucaauucgcauuacgaaacauagaaaaaggcaaauaugacaaaguaaugccauauggaccauccggaauaaaacaaggcgacacauuauauuuccccgcaguaggauuucuuguucgaacagaauuuacauacaacgauucaaacuguccaauagccgaaugccaauacucuaaacccgaaaauugccgucuaagcaugggaauacgaccaaacucacacuacauacucagaucaggauuacuaaaauacaaucucucagacgaagaaaacuccaaaauaguauucaucgaaauaucugaucaacgacuauccauuggcucacccucaaaaauauaugacucacuaggacaaccaguauucuaccaagccaguuuuucuugggacaccaugaucaaauucggagacguucaaacaguaaacccccucguaguaaauuggcgagacaauacaguaaucuccagaccaggucaaucgcaaugucccagauuuaacaaauguccagaagucuguugggaagguguauacaaugaugcauuucuuauagacagaauaaauuggauaucagcaggaguuuuuuuagacucuaaccaaaccgcagaaaacccagucuucacaguauucaaagacaaugaaguacuauaccgcgcacaauuagcaagcgaagacacaaacgcacaaaaaacuauaacuaauugcuucuuauuaaaaaacaaaauaugguguauaucucucguagaaauauacgauacaggagacaacguaaucagaccaaaauuauucgcaguaaaaauaccagaacaaugcacauaa

SEQ ID NO: 201 - RNA, 1815 nt, Artificial Sequence
  derived and/or modified CDS sequence (opt6) from Hendra henipavirus__NP_047112__G
augauggcagacucaaaauuaguaucacuaaauaauaaucuauccggaaaaaucaaagaccaaggaaaagucauaaaaaauuacuacggaacaauggauauaaaaaaaaucaaugacggacugcuagacucaaaaauacuaggagcauuuaacacugucauagcacuacuaggauccaucaucauuaucguaaugaacauaaugauaauacaaaauuacacaagaacuacagauaaucaagcccucauaaaagaaucccuacaauccguucaacaacaaaucaaagcccuuacagacaaaauaggaacagaaauagguccaaaaguaucacuaauugauacaucuucaacaauuacaauaccagcaaacauaggcuuauuaggaucuaaaauaucacaaucaacaagcucuauuaaugaaaacguaaaugauaaauguaaauucacccuaccaccacucaaaauacacgagugcaauauuucaugucccaacccauuaccauuuagagaauaucgaccaauaucucaaggaguuucagacuuaguaggacuaccuaaccaaauaugcuuacaaaaaacaacuucaacaauauuaaaaccacgccucauaucauacacacucccaauaaauacaagagaaggaguaugcauaaccgauccccuacuugcaguugacaacggcuucuucgcuuacucccacuuagaaaaaauagguucuugcacaagaggaauagccaaacaaagaauaauaggaguaggagaaguccuagacagaggagacaaaguaccaucaauguucaugacaaauguauggaccccaccaaacccaucuacaauacaccauugcucaucaaccuaccacgaagauuucuauuacacacuaugcgcaguaagccacguuggugaccccauacuaaacucaacuucauggacagaaucccuaagucuaauaagauuagcaguccgaccaaaauccgacucaggugauuauaaccaaaaauauauagcuaucacaaaaguagagcgaggaaaauacgauaaaguaaugccauauggaccauccggaauaaaacaaggcgauacacucuauuucccagcuguaggcuuccuaccacgcacagaauuucaauacaacgacucaaauuguccaauaauccacugcaaauacagcaaagcagaaaauugcagauuaaguaugggaguaaacaguaaaucacauuacauacuaagaucaggauuacuaaaauacaaccuaucucucggaggagacauaauauuacaauuuaucgaaauagcagacaaccgauuaacaaucggcucaccuuccaaaaucuacaacucacuaggucaaccaguauuuuaccaagcaaguuacucaugggacacaaugauaaaacuuggagacguagacacagucgauccccuacgcguacaauggagaaacaauucuguaauauccagacccggacaaucacaauguccacgauuuaacguaugucccgaaguaugcugggaaggaacauauaacgacgccuucuuaauagaccgacuaaacuggguaucugccggcguauaccuaaacucaaaccaaacagcagagaacccuguauuugccguauucaaagacaacgaaauacucuaccaaguaccauuagcagaagaugacacaaaugcacaaaaaacaauaacagacugcuuccuacuagaaaacgucauuuggugcauaucacuaguagaaauauacgacacaggagacagcguaauccgaccaaaacuuuuugcagucaaaauacccgcucaaugcuccgaaucauaa

SEQ ID NO: 202 - RNA, 1815 nt, Artificial Sequence
  derived and/or modified CDS sequence (opt6) from Hendra henipavirus__AEB21225__G
augauggccgacucaaaauuaguauccuuaaauaacaaccucucaggaaaaauaaaagaccaaggcaaaguaaucaaaaacuacuauggaacaauggacauaaaaaaaauuaaugacggacuacuagacagcaaaauucuuggagccuuuaauaccgucauagccuuauuaggcuccauaaucauuauaguaaugaacaucaugauuauacaaaacuacacaagaacaacugacaaccaagcacugauuaaggaauccuuacaaucaguacaacaacaaauaaaagcacuaacagauaaaauuggaaccgaaauaggcccaaaaguaucacuuauugacacuucauccacaaucacaauaccagcaaacauaggacuccuaggcucuaaaauaucucaaucaaccuccuccauaaacgaaaauguaaacgauaaauguaaguucacacuacccccuuuaaaaauacacgaaugcaauauaucauguccaaacccacuuccauuccgagaauacagaccuauaucacaaggaguaucagaucuaguaggauuaccaaaccaaauaugucuccaaaaaacuacauccacaaucuuaaaacccagauuaaucucuuauacauuaccaauaaauacaagagaaggcgucugcauaacagaucccuuacuagcugucgacaacggcuucuucgcauauucacaucuagaaaaaauaggaagcugcaccagaggaaucgccaaacaacgaauaauaggaguaggcgaaguucuagaccgaggcgacaaaguuccaucaauguucaugaccaacguauggacccccccaaaccccucaacaauacaccauugcucaucaacuuaucacgaagacuucuacuacacccuaugcgcaguaucacacguaggagacccaauacuaaacucaacaagcuggaccgaaagucucucacuaauuagacuugcaguaagaccaaaaagcgauuccggcgauuacaaucaaaaauauauagcaauaacaaaagucgaacgaggaaaguacgauaaaguaaugccauacggaccaucaggcauaaaacaaggagauaccuuauauuucccagcagucggcuuuuuaccuagaaccgaauuccaauacaacgacucuaacugcccuauaauucacuguaaauauuccaaagcagaaaacugucgauuauccaugggagucaacuccaaaucacacuauauucuaagaaguggacuauuaaaauacaacuuaucacuuggaggagacaucaccuuacaauuuauagaaauagcagauaauagacucacaauagguagcccuuccaaaauauacaauucacuaggccaaccagucuuuuaucaagcaucauacucaugggauacaaugauaaaacuaggcgacguagacacaguagacccuuuaagaguccaauggagaaauaacucaguaauaucacgacccggccaaucccaaugcccacgauucaacguuuguccggaaguauguugggaaggcacuuacaacgacgcauuccuaaucgauagacucaacuggguaucugcugguguauacuuaaauuccaaucaaacagcagaaaauccaguauucgcagucuuuaaagacaacgaaauacuauaucaaguuccccucgcugaagacgacaccaacgcacaaaaaaccauaacagacuguuuuuuauuagaaaacguaauauggugcaucucuuuaguagaaauauacgauacaggagacucaguaauacguccaaaauuauucgcagucaaaaucccagcucaaugcuccgaaucauaa

SEQ ID NO: 203 - RNA, 1815 nt, Artificial Sequence
  derived and/or modified CDS sequence (opt6) from Hendra henipavirus__AEB21216__G
augauggcagacucaaaacucgucucuccuaauaauaaucuaucuggaaaaaucaaagaccaaggaaaaguuaucaaaaacuacuacggaaccauggauauaaaaaaaaucaacgacggccuacuagauucaaaaauacuaggugcauucaacacaguaauagcacuacuaggaucaaucauaauaauaguaaugaacauaaugaucauacaaaacuacacacgcacaaccgauaaccaagcacuaauaaaagaaucauuacaaucaguccaacaacaaaucaaagcccucaccgauaaaaucggcacagaaauaggccccaaaguuucacucauagauacaucuaguaccauaaccaucccagcaaacaucggucuauuaggaucaaaaauaucacaaucaacauccucaauaaaugaaaaugucaacgauaaaugcaaauucacauuaccaccauuaaaaauccacgaaugcaacauaucaugucccaacccacucccuuucagagaauaccgcccaauaucccaaggagucucagacuuagucggauuaccaaaccaaaucugccuacaaaaaaccacaucuacaauacuaaaaccaagauuaaucucuuacacauuaccaauaaauacccgagaaggagucugcauuacugaccccuuacuagcuguagacaacggcuuuuuugcauacagccacuuagaaaaaaucgguuccugcacuagaggaauagcaaaacaaagaaucauaggaguaggcgaaguacuagaucgaggcgauaaaguaccaucaauguuuaugacaaaugucuggacacccccaaacccauccaccauccaccauugcucaucaacauaucacgaagacuucuauuacacacuuugcgcaguaagccacguaggugaccccauucuuaauucaacaucuuggacagaaucccuuucacucaucagacuagcaguaagaccaaaauccgacucaggagacuauaaccaaaaguauauagccauaaacaaagucgaaagaggaaaauacgauaaaguaaugccauauggcccauccggcauaaaacaaggagacacccuauauuuuccagccguaggcuuccuaccucgcacagaauuccaauauaacgauuccaacugcccaauaauacauugcaaauauucaaaagcagaaaacugcagacuaucaaugggaguaaacucgaaaucacacuacauccuuagaucaggccucuuaaaauacaaucuaucccuaggcggagacaucauauuacaauuuauugaaauagcagacaauagacuaacaauaggaucaccaucaaaaauauacaacucucuaggccaaccaguauucuaucaagcaucuuauucaugggauaccaugaucaaacuaggugaugucgauacuguugaucccuuacgaguucaauggagaaacaacuccguuauaucacgucccggucaaucacaaugucccagauucaaugucugcccugaaguauguugggaaggcacauauaacgaugccuucuuaauagaucgacuaaauuggguaucagcaggcguauaucuaaacucaaaccaaacagcagaaaacccaguauuugcaguuuucaaagacaaugaaauacucuaccaaguaccauuagcagaagaugacacaaaugcacaaaaaacuauaacagacuguuucuuauuagaaaacguaauaugguguauaaguuuaguagaaauauacgacaccggagacucuguaauaagacccaaacucuuugcaguaaaaauaccagcccaaugcucugaaucauaa

SEQ ID NO: 204 - RNA, 1815 nt, Artificial Sequence
  derived and/or modified CDS sequence (opt6) from Hendra henipavirus__AEB21206__G
augauggccgauucaaaacuugucucccucaacaacaaucuaagcggaaaaauaaaagaccaaggaaaagucauuaaaaauuacuacggaacaauggacauaaagaaaauaaacgauggauugcuagacucaaaaauacuuggagcguucaauacaguuauagcccuauuaggaucaauaauaaucauaguaaugaacauuaugaucauacaaaacuacacacgcacaaccgacaaccaagcacuaauaaaagaaagucuacaaucuguccaacaacaaauaaaagcacuaacugauaaaauuggaacagaaauaggccccaaaguaucucuaaucgacacaucaucaacaauaacaauaccagccaacauaggacuauuaggcucaaaaaucagccaaucaaccagcaguauaaaugaaaaugucaaugacaaaugcaaauucacauuaccaccucuaaaaauacacgaaugcaacaucucaugcccaaacccacuaccauuuagagaauacagaccaauaucccaaggaguaucugaccuaguaggccuaccuaaccaaauaugucuacaaaagacaacaucaacaauuuuaaaaccaagacuaauauccuacacauuaccaauuaacacaagagaaggcgucugcauaacagauccacuauuagccgucgacaauggauucuucgcauacagccaccucgagaaaauaggcucaugcacaagaggaauagccaaacaacgcauaauaggaguaggugaaguauuagaccgaggagacaaaguaccaagcauguuuaugacaaacguauggacuccuccaaacccaucaacaauacaccacuguucaaguacauaccaugaagacuuuuacuacaccuuaugugcaguaucacacgugggagaccccauacucaauucuacuucauggacagaaucacuaucucuaauaagauuagcaguaagaccaaaauccgacucuggaaacuauaaccaaaaauacauagcaauuacaaaaguagaaagagguaaauacgacaaaguaaugccauauggaccaucagguaucaaacaaggcgauacucuauacuucccagcagucggauuucuuccaagaacagaauuucaauacaaugacaguaacuguccaauuauacauuguaaauacucaaaagcagaaaauuguagacucucaaugggagucaacaguaaaucccacuacauauuacguucaggacuucuaaaauauaacuuaucauuaggcggcgacauaauccuacaauucauagaaauagccgacaacagacuuacaauaggaucaccaagcaaaauuuauaacucauuaggucaaccuguauucuaccaagcaucauacuccugggacacuaugauuaaauuaggagacauagacaccguagacccacuuagaguacaauggaggaacaacucuguaauauccagaccuggacaaagccaaugucccagauucaauguaugucccgaagucuguugggaaggaacguacaaugacgcauuccuaauagaccgccuaaacuggguaucagcuggaguauaccuaaacucaaaucaaaccgcagaaaaccccguauucgcaguauucaaagauaaugaaauauuauaccaaguaccucuagcagaagacgacacaaacgcacaaaagaccauaaccgacugcuuccugcuagaaaaugucaucuggugcaucagcuuagucgaaauauacgauacaggagacagcguaauacgacccaaacuauuugcagucaaaauaccagcacaaugcucugaauccuaa

SEQ ID NO: 205 - RNA, 1815 nt, Artificial Sequence
  derived and/or modified CDS sequence (opt6) from Hendra henipavirus__AEQ38052__G
augauggcugacucaaaauuaguaucguuaaauaacaaccuaucaggcaaaauaaaagaccaaggcaaaguaaucaaaaauuauuauggaacaauggauauaaaaaaaauaaacgauggcuuacuagacuccaaaaucuuaggagcauucaauacaguaauagcacuacucggaucaauaaucauaauuguaaugaacaucaugauaauacaaaacuauacucgaaccacagacaaucaagcccuuauaaaagaaucacuacaaucaguacaacaacagaucaaagcauuaacagauaaaauaggaacagaaauaggaccaaaaguaucucuaaucgacacaucaucaacaaucacuauaccagcaaacaucggauuacuaggaucaaaaaucucccaaucaaccucauccauaaacgaaaauguaaacgauaaaugcaaauuuacauuaccaccccucaaaauacacgaaugcaacauaucuugcccuaaccccuuacccuuccgcgaauaucgccccauaucacaagguguuucugauuuaguaggauuacccaaucaaauaugucuacaaaaaacaacaucaacaauucuaaaaccaagauuaaucucauacacacuuccaauaaauaccagagaaggaguaugcauaacagauccacuacucgccguagauaacggcuucuuugcauauucacaucuagaaaaaauaggaucauguacccguggaauagcuaaacaaagaauaauuggcgucggagaaguacuagauagaggagacaaagucccuuccauguucaugacaaauguauggacuccaccaaacccaucaacaauacaccauugcuccucuaccuaccacgaagacuuuuacuacaccuuaugcgcagucucccauguaggcgacccaauacugaacucaacaucauggacagaaucacuaucucuuauacgauuagccgucagacccaaaucugacucaggagauuauaaucaaaaauacauaacaauaacaaaaguugaaagaggaaaauacgauaaagucaugcccuacggaccauccggaauaaaacaaggagacacacuauauuucccagcaguaggcuucuuacccagaaccgaauuucaauacaacgacucaaauugcccaauaauccacuguaaauauucaaaagcugaaaauugccgauuaagcaugggaguaaauaguaaaucacacuacauauuaagaucaggacuucuaaaauacaaccuaucauuaggaggcgacauaauauuacaauuuauagaaauagcagacaaccgcuuaacaaucggaucaccaaguaaaauauacaacucacuagggcaaccaguuuuuuaccaagcaucauacucaugggacacaaugauaaaacuaggagauguagauacaguagaccccuuaagaguacaauggagaaacaacucaguuauaucucgaccaggacaaucacaaugcccuagauucaauguaugcccagaaguauguugggaaggaacauauaacgacgcauuuuuaauagaucgccuaaauuggguuucagcuggcguauacuuaaacucaaaucaaacagcugaaaaccccguauuugccguauucaaagacaaugaaauauuauaucaaguaccucuagcagaagacgauaccaaugcacaaaaaaccauuaccgacuguuuucuacucgaaaacguaaucuggugcauaucauuaguugaaauauacgauacaggcgacucagucauaaggcccaaauuauucgcaguaaaaauaccagcucaaugcuccgaaagcuaa

SEQ ID NO: 206 - RNA, 1815 nt, Artificial Sequence
  derived and/or modified CDS sequence (opt6) from Hendra henipavirus__AEQ38115__G
augauggcagacucaaaauuagucucauuaaauaauaacuuaucaggaaaaauaaaagaucaaggaaaagucauuaagaacuauuacgguaccauggacauaaaaaaaaucaacgacggacuacuagacagcaaaauacucggagcuuuuaauacuguaauugcauuauuaggaucaauaaucauaauaguaaugaacauaaugaucauacaaaacuacacaagaacaacugacaaccaagcccuaauaaaagaaucccuacaaucaguacaacagcaaauaaaagcauuaacagacaaaauaggaacagaaauaggaccaaaaguuagucuaauugacacgucaaguacaauaacaauuccagcaaauauaggucuauuaggaucuaaaauaucucaaucuaccucuucaauaaacgaaaacguaaacgauaaaugcaaauucacuuuaccuccacuuaaaauccacgaaugcaacauaucaugucccaacccccuacccuucagggaauacagaccuauaucacaaggaguaagugaucuaguaggccuaccaaaccaaauaugucuucaaaaaacuaccucaacaauccucaaaccacgacuaauauccuauacauuaccaauuaacacucgcgaaggaguauguauaacagacccacuucuagcaguagacaacggauucuucgcauacucucacuuagaaaaaauaggauccuguaccagaggaauagccaaacaaagaauaauaggaguaggcgaaguuuuagauagaggagauaaaguaccuuccauguucaugacaaauguauggacaccacccaacccaagcacaauacaucacugcucaagcacauaucaugaagacuucuacuacaccuuaugcgcaguaucucauguaggcgacccuauacuaaacuccacuucauggacagaaucacuaagccuaaucagacucgcuguacgaccuaaaucagauaacggagacuauaaccaaaaauauaucgcgaucaccaaagucgaaagaggaaaauacgauaaaguuaugccuuacggacccucuggaauaaaacaaggagacacacuauacuucccagcaguaggcuuucucccccgaaccgaauuccaauacaaugauucuaauugcccuaucauacauugcaaauacuccaaagcagaaaacuguagguuauccaugggaguaaauucuaaaucccacuauauccucagaucaggcuuacuaaaauacaacuuaucacuagguggcgauauuauauuacaauucauagaaauugcagacaacagauuaacuauuggaucacccucaaaaauauauaauucacucggacaaccaguauucuaccaagcaucguacucaugggacaccaugauaaaauuaggcgacgucgauacaguagacccacuaagaguacaauggagaaauaauuccgucauaucacgaccaggccaaucucaauguccaagauucaauguauguccagaagucugcugggaagguacauacaacgacgcuuuccuaauagauagauuaaacuggguaucagcaggagucuaccuaaacagcaaccaaacagcugaaaauccuguauucgcaguauuuaaagacaacgaaauacuauaccaaguaccacuagcagaagaugacacaaaugcacaaaaaacuauaacagacuguuuccuacuagaaaacguaauaugguguaucucacucgucgaaauauacgacacaggagacagcguaauaagaccaaaacuauuugccguaaaaaucccagcacaaugcucagaauccuaa

SEQ ID NO: 207 - RNA, 1815 nt, Artificial Sequence
  derived and/or modified CDS sequence (opt6) from Hendra henipavirus__AEQ38108__G
augauggccgauucaaaacuuguaucucuaaacaacaaccucucaggaaaaauaaaagaccaaggaaaaguaauuaagaacuacuacgguaccauggacauaaaaaaaauuaaugacggccuccuagauuccaaaauacucggcgcauuuaacacaguaaucgcacuucuaggaaguauaaucauuauaguaaugaauauaaugaucauacaaaacuauaccagaacaacugacaaucaagcacuaauaaaagaaucacuacaaucuguacaacaacaaauaaaagcacuaacagauaaaaucggaacagaaauaggucccaaaguaagucuaauugauacaucaucuacuauuaccauucccgcuaacauaggacuacuaggaucuaaaaucucacaauccacgucaucuauaaacgaaaauguaaaugacaaauguaaauucacccuaccaccacucaaaauucacgaauguaauauaucauguccuaacccacuuccauucagagaauauagacccauaucccaaggaguauccgaccuuguaggauuacccaaucaaauaugccuccaaaaaacaacgucaacaauacuaaaaccacgauuaauaucuuacacacuacccauaaacacacgagaaggaguaugcauaacagauccccuauuagcugucgacaauggauuuuucgcuuacucucaccuagaaaaaauagguucuugcacaagaggcaucgcaaaacaaagaauaaucgguguaggagaaguccucgacagaggagauaaaguaccaucaauguucaugacuaauguuuggacuccaccaaacccauccaccauacaccauugcuccagcacauaucaugaagacuuuuacuauacacuaugugccguaucacacguaggagaucccaucuuaaacagcacaagcuggacagaaucacuaucacucauaagacuagcaguuagacccaaaucagauucaggugacuauaaucaaaaauacauaacaauaaccaaagucgaaagaggaaaauacgauaaaguaaugccauacgggcccucagguauaaaacaaggcaacacauuauauuucccagcaguaggauuuuuaccaagaacagaauuucaauacaacgacucaaacugucccaucauacacuguaaauauuccaaagcagaaaauugcagacuaagcaugggaguaaacuccaaaagccacuacauacucagaucaggacuacuaaaauacaaccuaucacucggaggugauauaauccuacaauuuauugaaauagccgacaaccgucuaacaaucggaucaccaucaaaaaucuacaacucacuaggacaacccguauucuaucaagcuagcuauucaugggacacaaugauaaaauuaggagacguagacacagucgacccccuacgaguccaauggcgaaacaacucagucauaucaaggccuggacaaucgcaauguccacguuuuaacguaugccccgaaguuugcugggaaggaacauacaaugacgcauuucuuaucgauagacucaauuggguauccgccggcguauacuuaaacucaaaccaaacagcagaaaacccugucuuugcaguauucaaagauaaugaaauacuuuaccaaguaccacucgcagaagacgauacaaacgcacaaaaaacaauaacagauuguuuucuacuugaaaaugucauaugguguauaucacuaguagaaaucuaugauacaggagacucaguaauuagaccuaaacuauuugcaguaaaaauaccugcacaaugcuccgaaucguaa

SEQ ID NO: 208 - RNA, 1815 nt, Artificial Sequence
  derived and/or modified CDS sequence (opt6) from Hendra henipavirus__AAV80426__G
augauggcagacuccaaacucguaucacuaaauaacaacuuaucaggcaaaauaaaagaccaaggaaaaguaauaaaaaacuacuacggaacaauggauauuaaaaaaauaaaugauggacuacuagauaguaaaauacuaggagcauucaacacuguuauagcauuauuaggcucaauaauaaucaucguuaugaacauaaugauaauacaaaacuacacaagaacaacagauaaccaagcucuaauaaaagaaucacuacaauccguccaacaacaaaucaaagccuuaacugauaaaaucggaacagaaauaggacccaaaguauccuuaauagacacuucaucaacaauaacuauaccagcuaacauaggacuauuaggcagcaaaauuucucaaugcacaucuucuaucaaugagaacguaaaugacaaaugcaaauucacccuuccuccauuaaaaauucacgaaugcaacauaucgugucccaauccacucccauuuagagaauaucgaccaauaucccaaggcguaucagaucuaguaggccucccaaaccaaauuugccuacaaaaaacaacaucuacaauacuaaaaccccgcuuaauaagcuauacucuaccaauaaacacacgcgaaggcguaugcaucacugauccccugcucgcaguagauaacggguucuucgcauauagccaccuugaaaaaauaggaucauguacuagaggaauagcaaaacaaagaauaauaggaguaggagaaguccucgauagaggagauaaagugcccagcauguucaugacaaacguauggacaccaccaaacccuucaacaauccaccacuguucaucaacauaccaugaagacuucuauuauacacuaugcgcaguaucucacguaggagacccaauauuaaacuccacaagcuggacagaaucacuaucccucauaagacuugcuguaagacccaaaucugacuccggagacuacaaccaaaaauacauagcaauaacaaaaguagaaagaggaaaauacgauaaagucaugccauacggaccaaguggaauaaaacaaggagacacacuauacuucccagcuguaggauuccucccccgaacagaauuucaauacaacgauucuaacuguccaauaauacacugcaaauauuccaaagcugaaaacugccgauuaucaauggggguuaacucaaaaucacacuacauacuaagaucaggacuacuaaaauacaaccuaucacucggcggagacauaauacuccaauuuauugaaauagccgacaaucgacuaacaauaggaucaccaaguaaaaucuacaacucacuaggucaaccagucuucuaucaagccuccuacucaugggacaccaugauaaaacuaggagauguagacaccguagauccauuacgcguacaauggagaaauaacuccgucaucagucgacccggacaaucacaauguccacgauuuaauguaugcccagaaguauguugggaaggcucauauaaugaugcauuccuaauagacagacuuaauuggguaucagcaggaguauaccuaaauucaaaccaaacagcagaaaacccuguauuugccguauucaaagacaaugaaauuuuauaucaaguuccacuagcagaagacgacaccaacgcacaaaaaacaaucacugacugcuuucuacuagaaaacguuaucugguguauaaguuuaguagaaaucuaugauacaggagacucaguaauaagacccaaacuauucgccgucaaaaucccagcacaaugcucagaaagcuaa

SEQ ID NO: 209 - RNA, 1641 nt, Artificial Sequence
  derived and/or modified CDS sequence (opt11) from Nipah henipavirus__AAK50553__F
auggucguaauacucgacaaacgcuguuacugcaaccuacuuauacucauccuuaugaucucagaaugcuccgucggcauccuccauuacgaaaaacuaucaaaaaucggccucgucaaaggcguaacccgcaaauacaagauaaaaucaaacccgcuaaccaaagacaucguuaucaaaaugaucccaaacgucuccaacaugucccaaugcaccggcuccgucauggaaaacuacaaaacccgccuaaacggaauccucaccccaaucaaaggagcacucgaaauuuauaaaaauaacacccacgaccuagucggcgacguccgccuagcaggcguaaucauggcaggcgucgccaucggcauagccaccgccgcacagaucaccgccggugucgcccucuacgaagcaaugaaaaacgcugacaacaucaacaaacucaaauccuccaucgaauccacaaacgaagccgucguaaaacuacaagaaaccgccgagaaaaccgucuacguacucacagcccuccaagacuacauaaacaccaaccuaguacccaccauagacaaaaucuccuguaagcaaaccgaacuuagccuagaccucgcccucucuaaguaccucucagaccuccucuucguauuugguccuaaucuacaagacccgguauccaacucaaugacaauccaggccaucucccaagccuucggcggcaacuacgaaacccuccuacgcacccucggcuacgcaaccgaagacuuugacgaccuccuagaauccgacuccaucacaggccagaucauuuacgucgaccucucauccuacuacaucauaguaagagucuacuuccccauccucaccgagauccaacaagccuacauacaagaacuccuaccggucuccuucaacaacgacaauuccgaguggaucagcauaguccccaacuucauccucguacgaaacacccucaucagcaacaucgagauuggcuucugccucauaaccaaacgcuccgucaucugcaaccaagacuacgcaacccccaugaccaacaacaugcgugaaugccucacaggcagcaccgaaaaaugccccagagagcucguagucuccucccacgucccacgauucgcccuauccaacggcguccucuucgcaaacugcauuuccguuaccugccaaugccaaaccacaggacgggccaucucgcagucuggcgaacagacccuacuaaugaucgacaacacaaccugccccaccgccgucuuaggcaacgucaucaucucccugggaaaauaccucggcuccguuaacuacaacuccgaaggcaucgcaaucggaccucccgucuucaccgauaaagucgacaucuccagccaaaucuccuccaugaaucaaucucuccaacaaucaaaagauuacauaaaagaagcccaacgacuccucgacaccguaaaccccucacucaucagcauguuaucaaugaucauucuguacguacucuccaucgcgucccuaugcauaggccugaucaccuucaucucauucauaaucgucgaaaagaaacguaacaccuacucccgccuagaagaccgccgcguacgccccaccuccucuggggaccucuacuacaucgguaccuaa

SEQ ID NO: 210 - RNA, 1641 nt, Artificial Sequence
  derived and/or modified CDS sequence (opt11) from Nipah henipavirus__AEZ01388__F
auggccgucauccucaacaaacgcuacuacuccaaucugcucauacucauccucauuauuagcgaaugcucaguaggcauacuucacuacgaaaaacuguccaaaaucggccuugucaaagguaucacccguaaauacaaaauaaaaucaaacccccucaccaaagauaucgucauaaaaaugauccccaacgucucgaacaugucccaauguaccggcuccgucauggaaaacuacaagacccgccucaacgguauccuaaccccaauaaaaggcgcccuagaaaucuacaaaaacaacacccacgaccucgucggcgacguacgccucgccggcgucaucauggccggcguagccaucgggaucgccacagcagcccaaaucaccgccggcguugcccucuacgaagcaaugaaaaacgccgacaacaucaacaagcucaaaagcucaaucgaauccaccaacgaggccguagucaagcuccaggaaacagccgagaaaacugucuacguccuaaccgcacuccaagacuauauaaauaccaaccuaguaccaaccaucgacaaaaucagcugcaaacagacagaacugucccucgaccuagcccucagcaaauaccugagcgaccuacucuuuguauucggacccaaccugcaggaccccguuucaaacucaaugacaauacaagccaucucccaagccuucggcgggaacuacgaaacacuacugagaacccucggguacgccaccgaagacuucgacgaccuuuuagaauccgauagcauaaccggacaaaucaucuacguugaccuaagcggcuacuacauaauaguccgcguuuacuucccaauacucacagaaauucaacaagccuacauacaagaacuacucccaguguccuucaacaacgacaacuccgaauggaucuccauaguccccaacuucauccucgucaggaauacacuaaucagcaacauagagaucggcuucugccuaaucaccaaacguagcguaaucugcaaccaagacuacgccaccccuaugacuaacaacaugcgcgaaugccucaccgguucaaccgaaaagugcccacgagagcucgucgucuccucccacgugccccgcuucgcccucagcaacggcguccucuucgcaaacugcaucuccgugacaugccaaugccagacaaccggccgagccauuagccagucaggcgagcagacccuccucaugaucgacaacacaaccugcccaaccgccguccugggcaacgucauaauaucacugggcaaauaccucggaucugucaacuacaacucugaaggaauagccauaggcccacccguauucaccgauaaaguagacaucagcucccaaaucuccagcaugaaccaaagccuccaacaauccaaagacuacauuaaagaagcacaacgccuccucgacaccgucaaccccucauuaaucucaaugcucuccaugaucauccuauacguacugagcaucgccucccucugcaucggacuaaucaccuuuaucuccuucaucaucgucgaaaagaaacgcaacaccuacucgcgccuagaagaccgccgcguccgccccaccuccuccggugaccuguacuacaucggcaccuga

SEQ ID NO: 211 - RNA, 1641 nt, Artificial Sequence
  derived and/or modified CDS sequence (opt11) from Nipah henipavirus__AAY43915__F
auggccgucauacucaacaaacgauacuacucaaaccuccuuauccucaucuuaaugaucucugaaugcuccgucggcauccuacacuacgaaaaacucuccaaaauaggccuaguuaaaggcaucacucgcaaauacaagauuaaauccaacccccucacaaaagacaucgucaucaaaaugauccccaaugucuccaacaugucccaaugcaccggcuccgucauggaaaacuacaaaacucgccucaacggaaucuuaacccccaucaaaggcgcgcucgagaucuacaaaaauaacacccacgaccugguaggcgacguccgacuugcuggagucauaauggccggcguagccaucggcaucgcaaccgcggcccaaaucaccgcagggguugcccucuacgaggccaugaaaaacgccgacaacauaaacaaacuaaaauccagcaucgaauccacuaacgaagccguaguaaaacuccaggaaacggccgagaaaaccgucuacguacuuacagcccuucaagauuacauaaauacgaaccucguccccaccaucgacaagaucucaugcaaacaaaccgaacucucccuugacuuagcgcucuccaaauacuccagcgaccuacucuucguauucgggccuaaccuccaagacccaguaagcaacuccaugaccauucaagcaauaucacaagccuucgggggcaacuaugaaacccuacucagaacccucggcuacgccaccgaaggcuucgacgaccuucuagaaucagacucuaucacuggccagauaaucuaugucgaccuaagcggauacuauauuauuguucgcgucuacuuccccauccucaccgaaauccagcaagccuacauacaggaacuccuccccgucagcuucaacaacgacaacuccgaauggaucuccaucguccccaacuucauccucguucgcaacacccuaauaucaaacaucgaaaucggcuucugccuaaucaccaaacgcuccgucauaugcaaccaggacuacgccaccccaaugaccaacaacaugcgcgaaugccucacaggcuccaccgagaaaugcccacgcgagcuaguugucuccucacacgucccccgcuucgcauuaucaaacggcguacucuucgcaaauugcaucuccgucacaugccaaugccaaaccacaggccgugccauaucacaaucaggcgaacaaacccuucucaugaucgacaauacaaccugccccaccgccguacucgguaaugucaucaucucacugggcaaauaccuaggaucagucaacuacaacucagaaggcaucgccaucggcccacccgucuucaccgauaaagucgacaucuccucucaaaucuccuccaugaaccaaucacuccaacagagcaaagacuacaucaaagaagcacaacgacuccucgacaccgucaaccccucccuaauauccaugcucucgaugaucauccucuacguacucuccauagccagccucugcaucggccuaaucaccuucaucagcuucauaauaguagaaaagaaacgcaacacauauucccgacuggaagacagacgcguccgucccacauccucaggagaccuguacuacaucggaaccuaa

SEQ ID NO: 212 - RNA, 1641 nt, Artificial Sequence
  derived and/or modified CDS sequence (opt11) from Nipah henipavirus__CAF25496__F
auggucgucauacuugacaaacgaugcuacugcaaccuccucauacuuauccucaugaucucugaaugcuccguaggcauccuacacuaugaaaaacuaagcaaaauaggacucguaaaaggagucacccgcaaauacaaaauuaaaucuaacccacucacaaaagacauagucaucaagaugauccccaacgucuccaacaugucccaaugcaccggcucugucauggaaaacuacaagacccgacuaaacggcauccucaccccaauaaaaggcgcccuagaaauauauaaaaacaacacccacgaccuagucggcgauguucgacucgccggcgucaucauggccggcguagccaucggcaucgccacggcagcccaaaucaccgccggcgucgcccuauacgaagccaugaaaaacgccgacaacauaaacaagcucaagagcucgaucgaaucaacaaacgaagccgucgugaaacuacaagaaacagcagaaaagacaguauacguccucaccgcccuacaagacuacaucaacaccaaccuggucccaaccauagauaaaaucucaugcaaacaaacagaacucucacucgaccucgcccuaucuaaguaccuaucagaccuccucuucgucuucggccccaaccuacaagacccagucuccaacuccaugaccauccaagccauuucccaagccuucggcggcaacuacgaaacacuacuaagaacccucggcuacgcgaucgaagacuucgacgacuuacucgaaucagacuccaucaccggccaaaucaucuacgucgaccucuccucuuacuacaucaucguacgcgucuacuucccaauccucacagaaauccaacaggccuacauccaggaacuacuccccgucuccuucaacaacgacaacuccgaauggaucuccaucgucccgaacuucauccuaguccgcaacacucucauuuccaacauagaaaucggcuucugccucaucaccaagcgcucagucaucugcaaccaagacuaugcaacacccaugaccaacaacaugcgugaaugccucaccgguuccaccgaaaaauguccccgugaacucgucguaagcucccacgucccccgcuuugcccuauccaacggcguacucuucgccaacugcaucucaguaaccugccaaugccaaaccacgggucgagcaaucucacaaucaggcgaacaaacacuccuaaugaucgacaacacaaccugcccgaccgccgucuuaggaaacguaauaaucucacucggaaaguaccucgguuccgucaauuauaacucagaaggcaucgcuauaggucccccaguauuuaccgacaaggucgacauaaguagccaaaucuccuccaugaaccaaucccuacaacaauccaaagacuacauaaaggaagcccagcgacugcuagacaccgucaacccaucgcuaaucuccaugcuguccaugaucauccuauacguccugucaaucgccucucugugcaucggccucaucaccuucauaucuuucaucaucgucgagaaaaagcgaaacaccuacucacgacucgaagaccgacgcguccgcccuaccuccucgggugaucuuuacuacauaggcaccuga

SEQ ID NO: 213 - RNA, 1641 nt, Artificial Sequence
  derived and/or modified CDS sequence (opt11) from Nipah henipavirus__AAM13405__F
auggucgucauacucgacaaacgaugcuacugcaaccugcuuauccucauccuaaugaucuccgaaugcuccguaggaauacuacacuacgaaaaacucucaaaaaucggccuugucaaaggcgucacccgaaaauacaagaucaaauccaacccccucaccaaggacauugucauaaaaaugauacccaacgucuccaacaugagccaaugcaccggaagcgucauggaaaauuacaaaacacgucucaacgguauccucaccccgaucaaaggggcccuagagaucuacaagaacaacacacacgaccucgucggugauguacgacucgcaggcgucaucauggccggcgucgccaucgggaucgccaccgccgcccaaaucaccgcuggcgucgcucuuuaugaagccaugaaaaaugccgauaacaucaacaaacuuaaauccucuauugaauccaccaacgaggccgucgucaaacuccaagaaacagcugagaaaaccguguauguccucaccgcccuccaagacuacaucaacacaaaucucgucccuacaauagacaagaucucaugcaaacaaacagaacucucucuagaccuagcccucuccaaauaccuuagcgaccuacuauucguauucggacccaaccuccaagaccccgucuccaacucaaugacaauacaagccaucagccaggccuucggcggcaacuacgaaacacuccuucgcacccucggcuacgcuacagaagacuucgacgaccuacucgaauccgacucaaucaccggccaaaucaucuauguggaccucuccuccuacuacaucaucguccgcguauacuuuccaauccuaaccgaaauccaacaggccuauauacaagaacuccucccgguuuccuucaacaaugacaacuccgaauggauauccaucgucccaaacuucauccucguccgcaacacccuaaucagcaacaucgaaaucggcuucugccuuauaaccaaacgauccguuaucugcaaccaagacuacgccaccccaacaaccaacaacaugagagaaugccucaccggcuccaccgaaaaaugccccagagaacucgucguauccucccacguaccacgguucgcacuaucaaacggcguucuauucgccaacugcaucuccguaaccugccaaugccaaaccaccggccgcgcaauaucucaauccggcgaacaaacccuacuuaugaucgacaacacaaccugccccaccgccguccuaggcaacgucauaaucucccucggcaaauaccuaggcucagucaacuacaacagcgaaggcaucgccaucggaccucccgucuucacagacaaagucgacauauccucccaaaucuccaguaugaaccaaagccuacagcaaucaaaagacuacaucaaagaagcacaacgccuccucgacaccgucaaccccucccucauaucaaugcucucaaugaucauccucuacguccuuuccaucgccucccucugcaucggccuuaucaccuucauaucauuuaucaucgucgaaaagaaaagaaacaccuacucccgccucgaagaccgcagaguccgccccaccucgucaggcgaccucuauuauaucggcacauaa

SEQ ID NO: 214 - RNA, 1641 nt, Artificial Sequence
  derived and/or modified CDS sequence (opt11) from Nipah henipavirus__CBM41033__F
auggucgucauccucgacaaacgaugcuacuccaaccuccucauacuuauccucaugauuuccgaaugcucugucggcauccuccacuacgaaaaacucucaaaaauaggccuuguuaaaggcguaacccgcaaauacaaaaucaaauccaauccacugacaaaagacaucgucauaaaaaugaucgccaacguguccaacaugucucaaugcacaggcuccgucauggaaaacuacaaaacccgcuuaaacgguaucuuaaccccaaucaaaggagcacucgaaaucuacaaaaacaacacccacgaccuagucggcgacguccgacucgcuggcgucauaauggccggggucgcaaucggcaucgccaccgccgcccagauaaccgccggcgucgcacucuacgaagcaaugaaaaaugccgacaauaucaacaagcuaaaaucuagcaucgaauccaccaacgaagccgucgucaaacugcaagaaaccgccgagaaaaccgucuacguucucacagcccuacaagacuacaucaacaccaaccucguucccaccauagacaaaauaucgugcaaacaaaccgaacucucccucgaccucgcacuuuccaaauaccucucagaccuucucuucguguucggcccaaaccuccaagacccagucuccaacuccaugaccauacaagccauaucacaagccuucggaggcaacuacgaaacacuacuacgcacacucggcuacgccaccgaagacuucgacgaccuccuugaauccgacucgauuacaggccaaaucaucuacgucgaccuaagcagcuacuacauaaucguccgcgucuacuuccccauccucaccgaaauccaacaagccuacauccaagaacugcuccccgucagcuucaacaacgacaacucagaauggaucucuauuguaccuaauuucauccucguccgcaacacccucaucuccaauaucgaaauagguuucugccuaaucacuaaacgauccgucaucugcaaucaagacuacgccacccccaugacaaacaacaugagggaaugccucaccgggucaaccgagaaaugcccccgcgaacucgucgucuccucccacgucccucgauucgcgcucuccaacggaguccuauucgcaaacugcaucucuguaaccugccaaugccaaaccaccggacgcgcaaucucacaauccggugaacaaacucuccuaaugaucgauaacacaaccugccccaccgcuguacucggcaaugucauuauaucccuuggcaaauaccuaggaucggucaauuacaacuccgagggcauugccaucggcccucccguauucaccgacaaagucgacaucuccucccaaaagucauccaugaaccaaucucugcaacaauccaaagacuacaucaaggaagcccaacgccuccuagacaccgucaaccccucccucaucucaaugcucuccaugaucaucuuauacguacuaucuaucgccucccucugcaucggucucauuaccuucaucucuuucaucaucgucgaaaagaaacgaaacaccuacucacgccucgaagaccgccgcgugcgccccaccuccagcggagaccuuuacuacaucggcaccuaa

SEQ ID NO: 215 - RNA, 1641 nt, Artificial Sequence
  derived and/or modified CDS sequence (opt11) from Nipah henipavirus__AEZ01396__F
auggccgucauucucaauaaacgauacuacucgaaccuccuaauccucauccucaugaucuccgaauguuccgucggcauacuccacuacgaaaaacuuuccaaaaucgggcucgucaaagggaucacgcggaaauacaaaaucaaaucgaacccgcucaccaaagacauaguaauaaaaaugauuccaaacgucucaaacaugucccaaugcaccggcucagucauggagaacuacaaaacccgacucaacggaauacuaaccccaaucaaaggcgcccucgaaaucuacaaaaacaacacacacgaccuaguuggcgacguacgacucgcaggcguaauuauggccggcgucgcaauaggcauugccaccgccgcccaaaucaccgccggaguagcacuauacgaagccaugaagaacgccgacaacaucaauaaacucaaaucuucaaucgaaagcaccaacgaagcagucgugaaacuacaagaaaccgcagagaaaaccgucuacguucuuaccgcacuacaagauuacauaaacaccaaccucguuccaacaaucgacaaaaucucaugcaaacagacugaacuaagccucgaccucgcucucucaaaauaccucuccgaccuccuauucgucuucggccccaaccuccaagaccccguaagcaacuccaugacaauccaagcaaucucucaagccuucggcggcaacuacgaaacccuucuccgcacucuaggcuacgccaccgaagacuuugacgaccuacuagaauccgacucgaucaccggacaaaucaucuacgucgaucucuccggcuacuacauuauaguuagggucuacuucccaauacuuaccgaaauccaacaagcauacauccaggaacuccuccccgucucuuucaacaacgacaacucggaauggauaagcaucguccccaacuucauccucguccguaacacccucauaucaaacaucgaaaucggcuucugccuaauuacuaaacgcuccgucaucugcaaccaagacuacgccaccccaaugacaaacaacaugcgcgaaugccucaccggcucaaccgaaaaaugcccgagagaacucgucgucucaucucacgucccacgcuucgcgcuauccaacggcguacuuuuugccaacugcauuuccguuacaugccagugccaaacuaccgguagagcaaucucccaaagcggagaacaaacccuccucaugaucgacaacaccacaugccccaccgccguccucggaaacgucaucaucagccucggcaaauaccucggcuccgucaacuacaauucagaaggcaucgccauaggcccucccguauucaccgacaaagucgacaucuccucccagaucucauccaugaaucaaucgcuucagcaauccaaagauuacaucaaggaagcccaacgccuccucgacaccgucaaccccucccucaucucaaugcucucaaugaucauccuauacguccucucaaucgccagccucugcaucggccuaauaaccuucaucucauucauuauaguagaaaagaaacgcaacaccuacuccagacuagaggaccgccgagucagacccaccucauccggagaccucuacuacaucggaaccuaa

SEQ ID NO: 216 - RNA, 1641 nt, Artificial Sequence
  derived and/or modified CDS sequence (opt11) from Hendra henipavirus__NP_047111__F
auggccacacaagaaguacgccucaaaugccuccuaugcggcauuauaguacucguccuaucccucgaaggccuaggaauccuccauuacgaaaaacuaucaaaaaucggacuuguaaaaggcaucaccagaaaauacaaaauaaaauccaacccucucaccaaagauauugucaucaaaaugauccccaacguauccaacgucuccaaaugcacgggaacagucauggaaaacuacaaaagcagacuaaccggcauccucucaccgaucaagggcgcaaucgaacucuacaacaacaacacccacgaccucgucggcgacguuaaacucgccggcguagucauggccggcaucgcaaucggcauagccacggccgcccaaaucaccgccggagucgcacuuuacgaagcaaugaaaaacgccgacaacauaaacaagcuaaaauccuccaucgaaagcacaaacgaagccgucgugaaacuccaagaaaccgccgagaaaaccgucuacguucuaaccgcccuucaagacuacaucaacaccaaccucguccccacaauugaccaaauuucaugcaaacaaacagaacucgcccuagaccuagcccucagcaaauaccucuccgaccuccucuucgucuucggccccaaccuucaagacccuguauccaacagcaugacuauacaggccaucucccaagcauucggcggcaacuacgaaacccuacuccgcacccucggguacgccacagaagauuucgacgaccuccucgaauccgacagcaucgccggccaaauaguuuacguagaccuguccuccuacuacaucaucguacgcgucuacuucccaauccuaaccgaaauucaacaagccuacguacaagaacuccuacccgucucauucaacaacgacaacuccgaauggaucucaaucgucccaaacuucguccucauacgaaacacacugaucuccaacaucgaagucaaauacugccucaucacaaagaaaagcgucaucugcaaccaagacuacgccacacccaugaccgccuccguccgagaaugccuaacagguuccaccgacaaaugcccccgcgaauuagucgucuccagccacguccccagguuugcacucuccggcggcguccuauucgccaacuguaucuccguuaccugccaaugccagacuaccggcagagccaucucccaauccggagaacaaaccuuacucaugauugacaacacaaccugcaccaccgucguccuagguaacaucaucaucucccucgggaaauaccuaggcuccaucaacuacaacuccgaauccauugcggucggaccucccgucuacaccgacaaaguagacaucuccucccaaaucagcuccaugaaccaaucccuccaacaaucuaaagacuacauaaaagaagcccagaaaauccucgacaccgucaaccccucccucauuuccaugcucuccaugaucauccucuacguucuauccauagccgcccucugcauuggccuaaucaccuucaucuccuucguuaucgucgaaaagaaacgcggaaacuacucucgucucgacgaccgccaaguccgccccgucagcaauggcgaccuuuacuacaucggaaccuag

SEQ ID NO: 217 - RNA, 1641 nt, Artificial Sequence
  derived and/or modified CDS sequence (opt11) from Hendra henipavirus__AEB21233__F
auggccacccaagaaguccgccucaaaugccuccuuugcggcaucauaguucucguccucucccucgaaggccuaggcauccuccacuacgaaaaacucuccaaaauaggccucguuaaaggcauuacccggaaauacaaaaucaaaucgaacccccucaccaaagacaucgucaucaaaaugaucccuaacguaucaaacgucuccaaaugcaccgguaccgucauggaaaacuacaaaucccgacucaccgguauccucagcccuauuaaaggagccaucgaacuauacaacaauaacacccacgaccucgucggcgaugucaaacuggcaggcguugucauggccggaaucgccaucggcaucgcuacagccgcacaaauaaccgccggcguagcucuauacgaggccaugaagaacgccgauaacaucaacaaacuaaaaucauccauagaauccaccaaugaagccguagucaaacuccaagaaaccgcagaaaagaccguuuacguccucaccgcacuccaagacuacauuaacaccaaccuuguccccaccaucgaccaaauuuccugcaaacaaaccgaacucgcacucgaccucgcacucuccaaguaccuauccgaccuccuguucguauucggccccaaccuccaagaccccguauccaacuccaugaccauccaagccaucucccaagccuucggcggcaacuacgaaacccugcuacgaacgcucggcuacgcaaccgaagacuucgacgaucuccucgaauccgacuccaucaccgggcaaaucgucuacgucgaccugucauccuacuacaucauaguacgaguauacuuccccauccucaccgaaauccaacaagccuauguccaagaacuccuccccgucucuuuuaacaacgacaacagcgaauggaucucgaucguccccaacuucguccucauacgcaacacucuaauauccaauaucgaaguaaaauacugccucauaacaaagaaauccgucaucugcaaccaagauuacgccacaccuaugaccgccuccguacgagaaugccucaccggcucaaccgacaaaugcccccgugaacucgucguauccagccacguaccacgcuucgcccucucaggcggaguacuguucgcuaacugcaucucuguaacaugccaaugccaaacaaccggacgcgccaucucccaaucaggcgaacaaaccuugcucaugauugacaauaccacgugcacuacagucguucuaggaaacaucaucaucagccucggaaaauaccucggcuccaucaacuacaacucugaguccauugccgucgggccacccgucuacaccgacaaagucgacaucuccucucaaaucucauccaugaaccaaucccuacaacaguccaaagacuauaucaaagaagcccagaaaauccucgacaccgugaaccccucacuaaucucaaugcuaucuaugaucauccucuacguccuauccaucgcugcccucugcaucggccucauaaccuucaucagcuucguaauuguagaaaagaaacgcggcaacuacucacggcuagacgaccgccaaguccgacccguaucaaacggcgaccucuacuacauaggcaccuaa

SEQ ID NO: 218 - RNA, 1641 nt, Artificial Sequence
  derived and/or modified CDS sequence (opt11) from Hendra henipavirus__AEQ38114__F
auggccacccaagaaguccgacugaaaugccuccucugcggaaucaucguccuaguccucucgcuggagggccucggaauccuccacuacgaaaaacucucaaaaauugggcucgucaaaggcaucacccgaaaauacaaaaucaaauccaacccucucaccaaagacaucgucaucaaaaugauccccaacgucagcaacgucuccaaaugcaccggcacagucauggaaaacuacaaaucccgccucaccggaauacuaucuccuaucaaaggcgccaucgagcucuauaacaacaacacccacgaccucgucggcgaugucaaacuagccgggguuguaauggccggcauagccaucggcaucgcaaccgcugcacaaaucaccgccggugucgcccucuaugaagccaugaaaaacgccgacaacauaaacaaacuaaaaucuucaaucgaguccaccaacgaagccgucguaaaacuccaagaaaccgccgaaaaaaccguuuacguccucaccgcccugcaagacuacaucaacacaaaccucguacccaccaucgaucaaaucucaugcaaacaaaccgaacucgcucucgaccucgcccucuccaaauaccuuuccgaccuccucuucguauucggccccaaccugcaagaccccgucuccaacucaaugaccauucaagccauaucacaagccuucgggggcaacuacgaaacacuccuccgcacccucggcuacgcaaccgaagacuucgacgaccuacucgaauccgauucaaucacaggccaaauaguauacgucgaccuguccucauacuacaucaucguccgcgucuacuucccaauccucaccgagauccaacaagcauacguccaggagcuccuaccugucucuuucaacaaugacaacucagaauggauaucgauaguccccaacuucguccuuauccgcaacacacucaucagcaacaucgaagucaaauacugccuaaucaccaaaaaaucgguaaucugcaaccaagacuacgccacccccaugaccgccucaguucgagagugccuaacaggcuccacagacaaaugccccagagagcucgucguaucaucccacguaccucgcuucgcccuuuccggcggcguccuuuucgccaacugcaucuccgucaccugccaaugccaaacaaccggucgcgcgaucucacaaucgggcgaacaaacccuucuuaugauugacaacacaaccugcacaaccgucguacucggcaacaucaucaucucgcucggaaaauaccuaggcuccaucaacuacaacagcgaaagcaucgcugucggcccccccgucuacaccgacaaaguagacauuuccucccaaaucuccuccaugaaccaaucccuccaacaaagcaaagacuacaucaaagaagcccaaaaaauuuuagauaccgucaaccccucccucaucucaaugcuaucaaugauaauccuguacguacuguccaucgccgcccucugcaucggucucaucaccuucaucucauucauaauaguagaaaaaaaacgcggcaacuacucucgucucgacgaccgccaaguccgccccgucucaaacggugaccucuacuacaucggcacauga

SEQ ID NO: 219 - RNA, 1641 nt, Artificial Sequence
  derived and/or modified CDS sequence (opt11) from Hendra henipavirus__AAB39505__F
auggccacccaagaaguccgacucaaaugccuccuaugcggaaucauuguccuaguccucucccucgaaggacucgggauccuccacuacgaaaaacuuuccaaaaucggccucgucaaaggcaucacccgaaaauacaaaaucaaaagcaacccccuuacaaaagauaucgugaucaaaaugaucccuaacgucuccaaugucucaaaaugcaccggaaccgucauggaaaacuacaaaucccgccuuaccggaauacucucccccaucaaaggcgcaaucgaacucuacaacaacaacacacaugaccucgucggugacguaaagcucgccggcguggucauggccggcauagccaucgguaucgcaacagccgcccaaaucacagccggaguagcacucuacgaagccaugaagaacgcagacaacaucaacaaacuaaagucaaguaucgaauccaccaacgaagcuguugugaaacuccaagaaaccgcagagaaaaccgucuacguccucacagcacuccaagacuacaucaacaccaaccuuguccccaccaucgaccaaaucuccugcaaacaaacugaacuagcccucgaccucgcccucuccaaauaccuccucaucugcucaugcuucggccccaaccuacaagaccccguuuccaacagcaugaccauccaagcuauaucccaagcauucggcggaaacuacgaaacccuacuucguacacucggcuacgccacagaagacuucgacgaccuccucgagucagacuccaucaccggccaaaucgucuacgucgaccucucuuccuacuacaucaucguacgcguauacuuccccauccugacagaaauacaacaagcauacguccaagaacuucuccccguuuccuucaacaacgacaacucagaauggaucagcaucguuccaaacuucguacucauacgcaacacccucaucuccaacauagaagucaaauacugccuaaucaccaagaaauccgucauuuguaaccaggacuacgccaccccaaugaccgcgucaguccgagaaugccucaccggaucuaccgacaaaugcccccgagaacucguugucuccagccacgucccgcgcuucgcccuauccggaggaguacuauucgccaacuguauaucaguaaccugccaaugccaaacuaccggccgcgcaaucucccaaucgcgcgagcaaacccuccucaugaucgacaacacaaccugcacaaccgucguccucggcaacauaauuauaucucucccaaaauaucuaggaucuaucaaacugcagguacuccgagcccuucugcuaggccaccaauccauacagaccaaaguugauauauccagccaaaucuccucaaugaaccagucccugcaacaauccaaagacuacauaaaagaagcccagaaaauccuagacaccgucaacccaucccucauauccaugcucucaaugaucauccucuacguccucuccaucgccgcgcugugcaucggacucaucacuuucaucagcuucgucaucgucgaaaagaaacgcggcaacuacucccgccuugacgaccggcaaguacggcccgucucaaacggcgaccuauacuacaucggaacguaa

SEQ ID NO: 220 - RNA, 1809 nt, Artificial Sequence
  derived and/or modified CDS sequence (opt11) from Nipah henipavirus__AAK50554__G
augcccgcggaaaacaagaaaguccgcuuugagaacaccaccucagacaaaggcaaaauuccaucgaaagugaucaaaucuuacuacggcacaauggacaucaagaaaauuaacgaaggccuccuagacucuaaaauccucagcgccuucaacacagucauagcccuccuuggcagcaucgucauaaucguaaugaacaucaugauaauacaaaacuacacccgaucaacugacaaccaagccgucaucaaagacgcacuccaagguauccaacaacaaaucaaaggccucgccgacaaaauuggaaccgaaaucggccccaaagucagccucaucgacaccucaucaaccauaaccauacccgccaacauugggcuccucggcuccaaaauuucccagagcaccgccucaaucaacgaaaacgucaacgaaaaaugcaaguucacccucccaccccucaaaauccacgaaugcaacaucuccugccccaacccccuccccuuucgggaauaccgaccccaaaccgaaggcgucucuaaccucgucggccucccgaacaacaucugccuccagaaaacguccaaccaaauccucaaaccaaaacuuaucuccuacacccucccggucguaggccaaagcggaaccuguauuaccgacccccuccucgcaauggacgaaggcuauuuugcauacucccaccucgaacgaaucggaucaugcagccgaggcguauccaaacaacgaaucaucggcguuggcgaaguacuagaccgaggcgacgaggucccaucccucuuuaugacuaacgucuggacuccucccaaccccaacaccgucuaccacugcuccgccguauacaacaacgaguucuacuacguccucugcgcagucagcacagucggugaccccauccuaaacuccaccuacuggucaggcucacucaugaugacuagacuagccguaaaacccaaauccaacggcggaggcuacaaccaacaucaacucgcccuccgaagcaucgaaaaggguagauacgacaaagucaugcccuacggccccuccggcaucaagcaaggcgauacccucuacuuuccagccgucggauuccucguccgcaccgaguucaaauacaacgacucuaauugccccaucaccaaaugucaauacucaaagcccgaaaacugccgccucuccaugggcauccgucccaacucccacuacauccuccgauccggccuucuuaaguacaaccucucugacggagaaaaccccaaaguaguauucaucgaaaucucagaccaacgccucagcaucggcuccccauccaaaaucuacgacucccucggacaacccgucuucuaccaagcaaguuucucaugggacacaaugaucaaguucggggacguccugacaguaaacccccuagucgucaacuggagaaauaacaccgugaucucacgccccggccaaucccaaugcccccgcuucaauaccugccccgaaaucugcugggaaggugucuacaacgacgcuuuccuuauagaccgcaucaacuggaucuccgcaggaguguuccucgacuccaaccaaaccgccgaaaaccccguguuuacaguauucaaagacaacgaaauccucuaccgcgcccaacuagccuccgaggacacuaacgcgcagaaaaccaucaccaacugcuuccuccucaaaaacaagauauggugcaucucccuaguugaaaucuacgacacuggcgacaacgucauccgaccuaagcuguucgcaguuaaaaucccagaacaaugcaccuaa

SEQ ID NO: 221 - RNA, 1809 nt, Artificial Sequence
  derived and/or modified CDS sequence (opt11) from Nipah henipavirus__AEZ01389__G
augcccaccgaauccaagaaaguacgauucgagaacaccgcaagcgacaaaggcaaaaacccaucaaaagucaucaaauccuacuauggaaccauggacaucaagaaaauaaacgaaggccuccucgacuccaaaauacucucugccuucaacaccgucaucgcccuccucggaucaauagucaucauaguuaugaacauuaugaucauucaaaacuacaccagaucaaccgacaaccaagcaaugaucaaagacgcccuccaaagcauccaacaacaaauuaaaggccucgccgacaaaaucggaacugagaucggccccaaaguuucccucauugacaccuccucaacaaucaccaucccagcgaacaucggacuacugggcuccaaaaucucacaauccacagccuccauaaacgagaacgucaacgaaaaaugcaaguucacacucccgccacuaaaaauacacgaaugcaacauauccugccccaacccccuccccuuccgcgaauacaaaccccaaaccgaaggcgucucgaaccucgucgggcuaccaaacaacaucugccuccaaaagaccucgaaccaaauacucaagcccaaacuuaucagcuacacccuccccguagucggccaaagcggaaccugcaucaccgacccccuccucgccauggacgagggcuacuucgcauauucccaccuagagaaaaucggcuccugcagccgcggcguaucgaaacaacgaauaauaggaguaggagaaguacucgaccgaggcgacgaagugcccucccuuuucaugaccaacguguggacacccucaaaccccaacacagucuaccacugcagcgcggucuacaacaacgaguucuacuacguccuaugcgcagucucaguagucggagaccccauacuaaacucuaccuacugguccggcucccucaugaugacccgccucgccguaaagccgaaaaacaacggcgaauccuacaaccaacaccaauucgcucuccgaaacaucgaaaaagguaaauaugacaaagucaugcccuacggucccuccgguaucaaacaaggcgacacccucuacuucccagccgucggcuuccucguccgaaccgaguucaaauacaacgacuccaacugucccaucgccgaaugucaauauucaaaacccgaaaacugccgacucuccaugggcauccgcccaaauucucacuacauccuccgcuccggucuccucaaauacaaccuauccgaugaagaaaacucgaaaaucgucuucauugaaaucuccgaccaacgccuauccaucggcucgcccucaaagaucuacgauucccuaggccaaccggucuucuaccaagccuccuucucaugggacaccaugaucaaauucggcgacguccaaacugucaacccacucgucguaaacuggcgcgacaacaccgucaucucaagacccggacaaucccaaugcccccgcuucaacaaaugcccagaaguaugcugggaaggcgucuacaacgacgccuuccucauagaucgcauaaacuggaucucagcgggaguuuuccuggacuccaaucaaacagcagaaaaccccguauucacugucuucaaagacaacgaaguucuauaucgugcccagcuugccuccgaagacacaaacgcacagaaaacaaucaccaacugcuuccugcucaaaaacaaaaucugguguaucucccucgucgaaauauaugacacaggcgacaacgucauacgcccaaaacuguucgccgucaaaauccccgagcaaugcaccuaa

SEQ ID NO: 222 - RNA, 1809 nt, Artificial Sequence
  derived and/or modified CDS sequence (opt11) from Nipah henipavirus__ACT32615__G
augcccaccgaaagcaaaaagguacgcuucgaaaacaccgccucagacaaaggcaaaaacccuucaaaagucaucaaaagcuacuacggcacaauggacauaaagaaaauaaacgaaggccuccuagacuccaaaauacuauccgccuucaacaccguaauugcccuccucgggucaaucguaauaaucgucaugaacauaaugaucauccaaaacuacacgcgcucaacugacaaccaagccaugaucaaagacgcccuacaaucgauacaacaacagaucaaaggccucgccgacaaaaucggaaccgaaaucgguccgaaagucucacuaaucgacaccucaucaaccaucacaauccccgcgaacaucggcuuacuaggcucaaaaaucucacagucaacagcaucaaucaaugaaaacgucaacgaaaaaugcaaguucacccugccuccccucaaaauccacgaaugcaacaucagcugccccaacccccuacccuuccgggaauacaagccccagacagagggcguaagcaaucuaguuggccuuccaaacaacaucugcuuacagaaaaccuccaaccaaauccuaaaacccaaacuuaucagcuacacacuccccguagucggacaaucaggaaccugcauaaccgacccccuucucgccauggacgaagguuacuucgccuacucccaccuagagaaaauaggcucaugcucacgcggagucuccaaacaacgcaucaucggagucggagaaguccuagaccgaggcgacgaaguccccagccucuucaugacgaacgucuggacaccgucgaaccccaacacaguguaccacugcagcgccguauacaacaacgaguucuacuauguccuaugcgccgucuccgucgucggagaccccguccuaaacuccaccuacugguccggcucccucaugaugaccaggcuggccguuaaacccaaaaacaacggcgaauccuacaaccaacaccaauucgcccuuagaaacaucgaaaaaggaaaauacgacaaagucaugcccuacggaccauccggaauaaaacaaggcgacacccuguacuucccagcugucggcuuccuaguucgaaccgaguucaaauacaacgauagcaacugccccaucgcugaaugucaguacuccaaaccugaaaacugccggcuauccaugggcauccgccccaacucacacuacauccuaagaucaggacuccucaaauacaaccucuccgacgaagaaaacucuaagaucgucuucauagaaaucucagaccaacgcuuaagcaucggcucuccauccaaaaucuacgacucacuaggacaacccgucuucuaccaagcauccuucucaugggacacgaugaucaaguucggcgacguacaaacagucaacccccuaguggucaacuggcgagauaacaccgucaucucucgaccuggacaaucccaaugcccacgauucaacaagugcccagaagucugcugggaaggaguauacaacgacgccuuccucauugaccguaucaacuggaucuccgcaggcgucuuccucgacucaaaccaaaccgcagaaaaccccguguuuaccgucuucaaagacaacgaaguccucuaccgcgcccaacucgcaagcgaagacaccaacgcccaaaagacaaucacaaacugcuuccuucuaaagaacaaaauauggugcaucucccuaguggaaauuuacgacaccggugacaacgucauccggcccaaacucuucgcagucaaaauccccgaacagugcaccuaa

SEQ ID NO: 223 - RNA, 1809 nt, Artificial Sequence
  derived and/or modified CDS sequence (opt11) from Nipah henipavirus__CAF25497__G
augcccgcggaaaacaagaaaguacgcuucgaaaacacaaccagcgacaaaggcaaaaaccccuccaaagucauaaaauccuauuacggcaccauggacaucaagaaaauaaacgaaggacuccucgauucaaaaauacucuccgcuuucaacacaguaaucgcccuccucggauccaucguuaucaucguaaugaacaucaugauaauccaaaacuacacccgaucuacugacaaccaagcagucauaaaagacgccuuacaaggaauacaacaacaaaucaaaggacucgccgauaaaaucggcacugaaauaggccccaaagucagcuuaaucgacacaucauccacaaucacaauccccgccaacauaggucuacuugguuccaaaaucucccaaucaacagccucuaucaacgaaaacguaaacgaaaaaugcaaauucacccuacccccacucaaaauacacgaaugcaacaucuccugccccaacccccuccccuuccgcgaauaccgaccccaaaccgaaggcgucuccaaccucgucggccucccgaacaacauuugccuccagaaaacuagcaaucaaauccuaaaacccaaacucaucucauacacacugcccgucguaggccaaucgggaaccugcauaaccgacccccuccuagccauggacgaaggcuacuucgccuacucccaccuagaacggauuggcagcugcucccgcggcgucucaaaacaacgaauaaucggcguuggagaaguacuugaccgcggggacgaaguaccaucucuauucaugaccaacguaugggcaccaccuaacccuaacaccguauaccacugcuccgccguauacaacaacgaguucuacuacguccucugcgcagucucaaccguaggcgaccccauccucaacuccacuuacugguccggcucucucaugaugacccggcucgccgucaaacccaaauccaacggcgguggcuacaaccaacaccaacucgcucuccgauccaucgaaaaaggucgauacgacaaagucaugccguacggcccguccggcaucaagcaaggcgacacgcucuacuuccccgcagucggcuuccucguccgcaccgaguucaaauacaacgacucaaacugccccauaacaaaaugccaauacuccaaacccgaaaacugucgccucagcaugggcauccgaccaaacucgcauuacauccuacgauccggacuacuaaaguacaaccucuccgacggggaaaaccccaaaguuguuuucaucgaaaucuccgaccaacgccuuagcauaggauccccguccaagaucuacgacucgcuaggccagccagucuucuaccaagccaguuucuccugggacaccaugaucaaauucggcgacguccucaccgucaacccacuggucgucaacuggagaaacaacacugucauaucaagaccaggacaaucacaaugcccccgcuucaauaccugccccgaaauaugcugggaaggcgucuacaacgaugcauuccucaucgaccgaaucaacuggaucagcgccggcgucuuccucgacagcaaccaaacagccgaaaacccagucuucaccgucuucaaagacaacgaaauccucuaccgagcccaacuugccucagaagacaccaacgcccagaaaaccaucacaaacugcuuucuccucaaaaacaaaaucugguguaucucccuggucgaaaucuaugacacuggcgauaacgucauucgccccaaacuauucgcaguaaaaauccccgaacaaugcacauaa

SEQ ID NO: 224 - RNA, 1809 nt, Artificial Sequence
  derived and/or modified CDS sequence (opt11) from Nipah henipavirus__CBM41034__G
augccggcagaaaauaagaaagucagauuugaaaacaccacgagcgacaaaggcaaaaacccauccaaaguaauaaaauccuacuacggcaccauggacauaaagaaaaucaaugaaggacugcucgacucuaaaauccuauccgccuucaacaccgucaucgcccuccugggcagcaucgucaucauagucaugaacauuaugauaauacaaaacuacacccgcuccaccgacaaccaagccgucauaaaagacgcacuccaaggcauccaacaacaaaucaaaggacucgccgacaaaaucggaacagaaaucggucccaaagucucucucauagacacauccucaacuauaaccauccccgccaacauaggauugcucggaucaaaaauaucgcaauccaccgccuccaucaacgaaaacgugaacgaaaaaugcaaauucacccuaccaccccuaaaaauccacgaaugcaacaucucaugccccaacccacugccauuccgcgaauaccgcccccaaacagaaggcguaucuaaucucgucggccugccagacaacaucugccuccagaagacguccaaccaaauccuaaaacccaaacucaucucauacacacuacccgucgucggccaauccgggacaugcaucacggacccccuccucgccauggacgaaggguacuucgcauacucacaccuagaacgcaucgguucaugcuccagaggcgucuccaaacagcgcaucaucggcgucggcgaaguccuggaccguggcgacgaaguacccucccuguucaugaccaacguauggaccccucccaaccccaacaccgucuaccacugcucagccgucuacaacaacgaauuuuacuacguccuuugcgcugucaguacuguaggcgauccuauccucaacucgaccuacuggucaggaucccucaugaugacgcgucuugcagucaaacccaaaucaaacggcggcggcuacaaccaacaccaacucgcccuacgcagcaucgaaaaaggccgauacgacaaagucaugccauacggucccuccggcauuaaacagggcgacacacucuacuuccccgccgucggcuuccucguuagaacagaguucaaauacaacgacucaaacugcccaauaacaaaaugccaauacucaaaacccgaaaauugccgccuauccaugggcauacgccccaacagccacuacauccuccgauccggccuacucaaauacaaccucucagacggcgaaaaccccaaaaucguauucaucgaaauauccgaccaacgacucuccaucggcucucccucgaaagucuacgacucacuaggacaaccagucuuuuaccaagcuagcuuuucaugggacaccaugaucaaguucggagacguacaaacaguuaacccucucguuguuaacuggcgcgacaacaccgucauaucccgacccggccaaucccaaugcccccgcuucaauaccugccccgaaaucugcugggaaggaguauacaacgacgccuucuuaaucgaccgaauaaacuggaucuccgccggcgucuuccucgacuccaaccaaacagccgaaaacccugucuucacuguauuuaaagacaacgaaauacuauaccgcgcccaacucgcaagcgaagacaccaacgcacagaaaacaauaaccaacugcuuccuccucaaaaauaaaauauggugcaucagccuggucgaaauuuacgacaccggagacaacgucaucagaccuaaacucuucgccgucaaaauccccgaacaauguacauga

SEQ ID NO: 225 - RNA, 1809 nt, Artificial Sequence
  derived and/or modified CDS sequence (opt11) from Nipah henipavirus__AAX51853__G
augccugccgaaagcaagaaaguccgcuucgagaacaccacaucagauaaaggcaaaauuccaagcaaaauuauaaaauccuacuacggaaccauggacauuaagaaaaucaacgaaggacuccuagacuccaaaauccucagcgccuucaacaccguaauagcccucuuaggcagcaucgugaucauagucaugaacauuaugaucauucaaaacuacacacgauccacugacaaccaagcugucauaaaagacgccuuacaaggcauccagcaacaaauuaaaggccucgcagacaaaaucggcacugaaauaggccccaaaguaucccuaauagauaccuccuccacaauaacuauaccagccaacaucggucuucuagguucuaaaaucucacaauccaccgcaagcaucaacgaaaacguaaacgaaaaaugcaaauucaccuugccaccccuaaaaauccacgaaugcaauaucuccugccccaacccccuccccuuccgagaguacagaccccaaaccgaaggcgucucgaaccucgucggccucccgaacaacauaugucuacaaaagaccucaaaccaaauccuuaaacccaaacucauaagcuacacgcuccccguagucggccaaucaggcacgugcaucacagacccccuacucgcaauggacgaaggcuacuucgccuacucucaccuggaacgcaucggcuccuguucuagaggcguauccaaacagaaaauaaucggggucggcgaaguccucgaccguggagacgaaguccccucccuauucaugacaaacguauggaccccacccaaccccaacaccgucuaccacugcuccgcaguuuacaacaacgaguucuacuacguacucugugcagucuccaccguaggcgaccccauacucaacuccaccuauuggagcggaucccuaaugaugacccggcucgccgucaaaccaaaaucaaacgacggcggcuacaaccaacaccaacucgcccuacgcucaauugaaaaaggccgauaugacaaagucaugcccuacggucccucuggcauaaaacaaggagauacacucuacuucccugcagucggcuuucucguacgcacagaguucaaauacaacgacucaaacugccccaucacuaaaugccaauacuccaaacccgaaaacugccgccucuccaugggaauccgccccaacucccacuacguccuccgauccggacuccucaaauacaaccuauccgacggcgaaaaccccaaaaucguauucaucgaaaucuccgaccaacgccuaucaauuggaucacccucaaaaaucuacgauucucucggucaacccguuuucuaccaagccucauucucgugggacaccaugauaaaguucggagacgugcaaaccgucaacccacucgucguauccuggcgagacaacacagucauaucccgcccgggacaaucccaauguccccgcuucaauacaugccccgaaaucugcugggaaggcgucuacaacgacgcauuccucaucgaccgaaucaacuggaucuccgccggcgucuuccuagacucgaaccaaaccgcagaaaaccccgucuucaccgucuuuaaagacaacgaaauccucuaccgcgcgcaacuagccuccgaagacacaaacgcccagaaaaccauaaccaacugcuuccuccucaaaaacaaaaucuggugcaucucacucgucgaaaucuacgacaccggcgacaacguuauccgccccaagcuauucgccguuaaaaucccagagcaaugcacauga

SEQ ID NO: 226 - RNA, 1809 nt, Artificial Sequence
  derived and/or modified CDS sequence (opt11) from Nipah henipavirus__AEZ01397__G
augccuacagaaucaaagaaaguccgcuucgaaaacaccgccucagacaaaggcaaaaaccccagcaaagucaucaaaucuuacuacggcacaauggacaucaagaaaaucaacgaaggccuccuagacucaaaaauccucucagcauucaacacuguaauagcacugcucgggucaauagucaucaucguaaugaacaucaugauaauacaaaacuacacccgaagcaccgacaaccaagccaugauaaaagaugcccuucaauccauccaacaacaaaucaaaggccucgcagacaaaauagggaccgaaaucggacccaaagucucccuaaucgacaccuccucaaccaucacuauccccgcaaacaucggccuccuaggauccaaaaucucacaauccaccgcaagcauaaacgaaaacgucaacgaaaaaugcaaauucacccuaccaccccuaaaaauucacgaaugcaacaucucaugccccaauccccuaccauuccgcgaauacaaaccucaaaccgaagggguaucuaaccucgucggucuccccaacaacaucugccuccagaaaaccuccaaccaaauucucaaacccaaacuaauauccuacacacuccccgucguagggcaguccggcacaugcauaacggacccccuucucgccauggacgaaggcuauuucgcauacucccaucuggagaaaaucggcuccugcagccgcggcgucucgaaacaacgaaucaucggcguaggagaaguccucgaccgcggcgacgaagugccaagucucuucaugacaaacgucuggacccccuccaacccaaacaccgucuaccacugcuccgccguauacaauaacgaguucuacuacguccuaugcgcagugucugucgucggagacccgauucuaaacuccaccuacuggagcggcucacucaugaugacccgacucgcagucaaacccaaaaacaacggagaauccuacaaccaacaccaauucgccuuacguaacauagaaaaaggaaaauaugacaaggucaugccauacggccccuccggaaucaaacaaggcgacacccuauauuucccggccgucggauuucuaguccgcacugaguucacauacaacgacaguaacugccccauagccgaaugccaauauagcaaacccgaaaacugccgauuauccaugggaauccgacccaacucccacuacauccuccgcucagggcuccucaaauacaaccugagcgacgaagaaaacuccaaaaucgucuucaucgaaauauccgaccaacgccuaagcaucggcucacccagcaagauauaugacucccucggccaacccgucuucuaccaagcaucauucuccugggacaccaugauaaaauucggcgacguucaaacgguaaacccacucguaguuaacuggcgcgacaacacagucaucagccgccccggccaaucccaaugcccccgauuuaauaaaugccccgaagugugcugggaaggagucuacaacgacgccuuccugauagaccgcaucaacuggaucagcgcaggcgucuuccucgacuccaaccaaaccgccgaaaaccccgucuucacagucuucaaagacaacgaaguccuauaccgcgcacaacucgccucagaggacaccaacgcccagaaaaccaucaccaacugcuuccuucucaaaaacaaaauauggugcaucagccucgucgagaucuaugacacaggcgacaacgucauccgccccaaauuauucgccguaaaaaucccugaacaaugcacauaa

SEQ ID NO: 227 - RNA, 1815 nt, Artificial Sequence
  derived and/or modified CDS sequence (opt11) from Hendra henipavirus__NP_047112__G
augauggccgacucaaagcuagucucccuaaacaacaaccucucaggcaagaucaaagaccaaggcaaaguuaucaaaaacuacuacgguaccauggacaucaagaaaaucaacgacggccuccuugauucuaaaauacuaggagccuucaacacagucaucgcacuccuaggauccaucauaaucaucgucaugaacaucaugauaauccaaaacuacacucgaacaacagacaaccaagcacuaauaaaagagucacuccaguccguccaacaacaaaucaaagcacuaacagacaaaauaggaaccgagaucggucccaaagucucccuuaucgacacauccuccaccauuaccaucccagccaauauuggccuacuuggcuccaaaaucucccaaucaaccucaucaauaaacgaaaacgucaacgacaaaugcaaauucacccucccaccccuaaaaauccacgagugcaacaucuccugccccaacccacuucccuuccgcgaauaccgucccaucucccaaggcgucuccgaccuuguaggccucccuaaccaaaucugccuacagaaaaccacaagcaccauacucaaaccccgacuaaucucauacacccuaccuaucaacacacgagagggcgucugcaucaccgauccacuacuagcuguugacaacggcuuuuucgccuacucccaccucgagaaaaucggaucaugcacucgcggcauagccaaacaacgcaucaucggcgucggagaaguccucgaccgaggcgacaagguucccuccauguucaugaccaacguuuggacacccccuaaucccucaaccauccaccacugcuccucaaccuaccacgaagacuuuuacuacacccucugcgcagucucccacgucggcgaccccauacuaaacuccaccuccuggacagaaucccucucccucauccgucuggccguccgccccaaaucagacagcggagacuacaaccaaaaguacaucgcgauaaccaaagucgaacgcggcaaguacgacaaaguaaugcccuacggccccuccggcaucaaacaaggagacacucuauacuucccagcaguaggcuuccuaccccggacugaguuccaauacaacgacucaaacugccccaucauacacugcaaauacucaaaagcagaaaacugccggcucagcaugggggucaacucuaaaagccacuacauacuccgauccggauuacucaaauacaaccuaucccuaggcggcgacauaauccuccaguucauugaaaucgcugacaaccgccuuaccaucggcagcccaucaaaaauauacaacucucuaggacaacccgucuucuaccaagccuccuacuccugggacaccaugaucaaauuaggagacgucgacaccguagacccgcuccgcguacaguggcguaacaacucugucaucucccgccccggacagucucaaugcccccgcuucaaugucugccccgaaguaugcugggaaggcacguacaacgacgcauuccucaucgaccgccuuaacugggucucagcaggcguauaccucaacuccaaccaaacugccgaaaaccccguuuucgccguuuucaaggacaacgaaauccuauaccaagucccccucgccgaagacgacaccaacgcccagaaaacaaucacggacugcuuccuccuagaaaacguaaucuggugcaucagcuuagucgagaucuacgacacaggcgauucagucauacgccccaaacuauucgcuguuaagauccccgcccaaugcuccgaaaguuag

SEQ ID NO: 228 - RNA, 1815 nt, Artificial Sequence
  derived and/or modified CDS sequence (opt11) from Hendra henipavirus__AEB21225__G
augauggccgacuccaaacuugucagccugaacaacaaucuauccggcaagaucaaggaccaaggcaaaguaaucaaaaacuacuacggcaccauggacauaaagaagaucaacgacggucuacucgacuccaaaauccuaggagccuucaacacuguuauagcacuccucggcaguaucaucauaaucgucaugaacauaaugaucauacagaacuacacaaggaccaccgacaaccaagcccucauaaaggaaagccuacaauccguccaacaacaaaucaaagcacucaccgacaagaucggcaccgaaaucggacccaaggucucacuaaucgauaccucauccacaauaaccauaccagccaacaucgggcuacucggcucaaaaaucucccaguccacaagcuccauuaacgaaaacgucaacgacaaaugcaaguucacacucccgccccucaaaauccacgaaugcaacauauccugccccaacccccuccccuuccgugaauaccgcccgaucucucaaggugucucagaccucguaggccuccccaaccagaucugccuccaaaagacgaccucaacaauccucaaaccacgccuaaucuccuacacccuccccaucaacacccgagaaggagucugcaucaccgacccacuacucgccgucgauaacggcuucuuugccuacucacaccucgaaaagaucggauccugcacgcgcggcaucgcaaaacagcgcauaaucggcgucggcgaaguccucgaccgcggcgacaaagucccuagcauguucaugaccaacguauggaccccacccaaccccuccaccauccaccacugcagcaguacauaccacgaagacuucuacuacacccucugcgcugucucccacgugggagacccaauccucaauuccaccucauggaccgaaucgcucucccucauccggcuagccguucgccccaaauccgacuccggagacuacaaccagaaauacaucgcaauaacgaaagucgaaagaggcaaguacgacaaagucaugccguacggccccuccggaaucaaacaaggagacacccucuacuucccggccguaggauuccucccccgaaccgaauuucaauacaacgacucaaacugcccaauuauacacugcaaauacuccaaagccgaaaacugcagacuaucaaugggagucaacuccaaaucucacuacauacuccgcuccggacuccucaaauacaaccucucccugggcggcgacaucacacuccaauucaucgaaaucgccgacaaccgccucaccaucggcagccccucaaaaauauacaacucccucggacagcccgucuucuaccaggccuccuacucgugggauacaaugauaaaacucggcgacgucgacaccgucgacccccuucgaguccaauggcguaacaacucagucaucuccagacccggccaaagccaaugcccaagauucaacgucugccccgaaguaugcugggaaggaacauacaacgacgccuuccuuaucgaccgccucaacugggucucugccggcguauacuuaaacagcaaucaaaccgccgagaacccagucuucgcagucuuuaaagauaacgaaauccuauaccaagucccacucgcagaagacgacacaaacgcccagaaaacgaucacagacuguuuccuacuagaaaacgucaucuggugcaucagucucgucgaaauauacgacaccggcgacagcguaauacgccccaaacuuuucgccguaaagauccccgcucaauguucugaaucuuag

SEQ ID NO: 229 - RNA, 1815 nt, Artificial Sequence
  derived and/or modified CDS sequence (opt11) from Hendra henipavirus__AEB21216__G
augauggcagacagcaaacucgucucacccaauaacaaccuauccggcaaaaucaaagaccaaggcaaggucaucaaaaacuacuacggcaccauggacauaaagaaaaucaacgacggccuacuagacuccaaaauccucggagcauucaacaccgucaucgcccugcucggcucuauaauaaucauugucaugaacaucaugaucauccaaaacuacacacgcaccacagacaaccaagcccuaaucaaagaaagccuacaaucuguacaacagcaaaucaaagcacuaacagacaaaauuggcaccgaaauuggccccaaagucucccucaucgauacauccucaaccaucacaauacccgccaacaucggccuucucggcucuaaaauaucccaaagcaccuccucuaucaacgaaaacguaaacgacaagugcaaguucacacuaccaccccucaaaauccaugaaugcaauauaucaugccccaacccccuccccuuuagagaguaccgcccaaucucccaaggcgucuccgaccuggucgggcuaccaaaccaaaucugccuccagaaaacaaccuccaccauacuaaaaccccgccuuaucagcuacacccuacccaucaacacacgagagggcgucugcaucaccgacccccuccucgccgucgauaacggcuucuucgccuacagucaccucgaaaagaucggaagcugcaccagaggcaucgccaaacaacgcaucaucggcgucggagaaguucuugaccgcggcgauaaaguacccagcauguucaugacaaacgucuggacaccacccaacccaucaaccauccaccauugcuccucgacuuaccacgaagacuucuacuacacccuaugcgcgguuucccacguaggagaccccauccuuaacuccacgucuuggaccgaaucacucucccucauccgacuggccguacgccccaaaucugacuccggcgacuacaaccaaaaauauauugcaaucaacaaagucgaaagaggaaaauacgacaaagucaugccuuauggcccaagcggcaucaaacaaggagacacacucuacuuccccgccgucggcuuccucccccggaccgaguuccaauacaacgacuccaacugcccgauaauccacugcaaauacagcaaagcugaaaacugcagacuguccaugggagucaacuccaaaagccacuacauccuccgcuccgggcugcucaaauacaaccuaucccuugggggcgacaucauccuccaauucaucgaaauagcugacaacagacucacaauaggaucccccuccaaaaucuacaacucccucggucagccagucuucuaccaagccuccuacuccugggacacgaugaucaaacuaggugacgucgacacagucgacccccuacgaguccaauggcgaaacaacuccgucauaucccgccccggccaaagccaaugcccacguuucaacgucugccccgagguauguugggaaggcaccuacaacgacgcauuccucauagaccgacucaacugggucuccgccggcguauaccucaacagcaaccaaacugccgaaaaccccgucuuugccgucuuuaaggacaacgaaauccucuaccaagucccccucgccgaggaugacacuaacgcccagaaaaccauaaccgacuguuuucuucucgagaacgucaucuggugcaucagccucgucgagaucuacgacaccggcgacuccgucauacgacccaaacucuucgcagucaaaaucccagcacaaugcucugaguccuag

SEQ ID NO: 230 - RNA, 1815 nt, Artificial Sequence
  derived and/or modified CDS sequence (opt11) from Hendra henipavirus__AEB21206__G
augauggcugacagcaaacucguuucccucaauaauaaccucuccggcaaaaucaaggaccagggcaaaguaaucaaaaacuacuacgggaccauggacauaaagaaaauaaacgacggccugcucgacuccaaaaucuuaggcgcauuuaacacugucauagcgcuccuaggauccaucaucaucauagucaugaacaucaugaucauucaaaacuacacccgaaccaccgacaaucaagcacucaucaaagaaucccuccaauccguccaacaacaaauaaaagcacuuacggacaagaucggaaccgaaauuggccccaaagucagccucaucgacacgagcuccacgauaaccauccccgccaacaucggccuccucggauccaaaauuucccaauccaccuccucaauaaacgaaaacguaaacgauaaauguaaauucacccuacccccauuaaaaauccacgaaugcaacauaucaugcccuaacccacuccccuuucgagaauaucgacccauaagccaaggugucagcgaccuaguaggccuccccaaccaaauaugccuccagaaaaccacauccaccauccuaaaaccacgccucauaucuuacacccuacccauaaacacucgagaaggggucugcauaaccgacccacuccucgccgucgacaacggguucuucgccuacucccaccuugagaaaaucggaagcugcacacgcggcauagcaaagcaaagaauaaucggcgucggagaaguacucgaccgcggcgacaaaguccccuccauguucaugaccaacgucuggaccccaccaaaccccuccaccauccaccacugcuccuccaccuaccacgaggacuucuacuacacacucugcgcaguaucacaugugggcgaccccauccucaacuccacauccuggaccgaaagccucucccucauccggcuugccguacguccuaaauccgacagcggaaacuacaaccaaaaguacaucgcaaucacaaaagucgagcggggcaaauacgacaaagucaugccauacggacccuccggcauaaaacaaggagacacccuauacuuccccgccgucggauuccuaccccgcaccgaguuccaauacaacgacuccaacugccccaucauacacuguaaauacucgaaagccgaaaacugccgccucuccaugggagucaacucuaaaucccacuacauccuccgcuccggccuccugaaauacaaccuaagccucgggggcgacaucauccuacaauucaucgaaaucgcggacaaccgacucacaauaggcucacccaguaaaauauacaacagccucggccaaccugucuucuaccaagccucauacuccugggacaccaugauaaaacucggcgacaucgacacagucgacccacugcgcguccaauggcgaaacaacuccguuaucucccguccuggacaaucucaaugcccccgauucaacguaugcccagaagucugcugggaaggaaccuacaacgacgccuuccuuauugaccgacucaacugggucucugcgggcguauaccuuaacuccaaccagaccgccgaaaaccccguauucgcagucuucaaagauaacgaaauccuauaccaagucccccucgccgaagaugacaccaacgcccagaaaacaaucaccgacugcuuccuccucgaaaacguaaucuggugcaucucccucguugaaauauacgacaccggcgacuccguaauacgacccaaacuauucgcugucaaaauccccgcacaaugcucagaauccuaa

SEQ ID NO: 231 - RNA, 1815 nt, Artificial Sequence
  derived and/or modified CDS sequence (opt11) from Hendra henipavirus__AEQ38052__G
augauggccgacuccaaacucgugucacuaaauaauaaccugagcggcaaaaucaaagaccaaggcaaagucaucaaaaauuacuacggcacaauggacaucaagaaaauaaacgacggccuccucgacuccaaaauucucggcgcauucaacaccgucaucgcacugcucggcuccauaaucauaaucguuaugaacaucaugauuauccaaaacuacacacguaccacagacaaccaagcccucauuaaagaauccuuacaauccguccaacaacaaauaaaagcccucaccgacaaaauaggcacugaaaucggccccaaaguaucccucauugacaccagcuccaccaucaccaucccagccaacaucggccuacucgguucgaaaaucucccaaucgacuucauccauaaacgaaaacguaaacgauaagugcaaguucacgcuacccccacuaaaaauacacgaaugcaacauauccugcccaaacccccucccuuuccgcgaauacaggccaaucucccaaggcgucuccgaccuaguaggccuaccuaaccaaauuugccuccaaaagacaaccuccacgauccucaaaccacgccuaauauccuacacccuucccaucaacacccgcgaaggaguaugcaucacagacccacuccucgccgucgacaacggcuucuuugcauauucacaccucgagaaaaucggcucuugcacacgcggcaucgcaaaacaacgcaucaucggcgucggugaaguccuagacagaggcgacaaaguacccuccauguucaugaccaacguauggaccccgccaaaccccucgaccauacaccacuguuccuccaccuaccacgaagacuucuacuacacacucugcgcagucucccacguaggggaccccauccucaacucgacauccuggaccgaaucacuuucccuaauccgccuagcaguacggcccaaaucagacuccggcgacuacaaccaaaaauacauaacaauuaccaaagucgaacguggaaaauacgauaaaguaaugcccuacggccccuccggcauaaaacaaggcgacacacucuacuuccccgcagucggauuccucccccgaaccgaguuccaauacaacgacucaaacugccccaucauacacuguaaauacucaaaagcagaaaacugccgccucuccaugggcguaaacucaaaaucccacuacauucuccgcagcggacuacugaaguacaaccucucacucggcggcgacauuauucuucaauucauagaaaucgccgacaaccgcuuaacaauaggcucacccucaaagaucuacaauucccuuggccaacccgucuucuaccaagcauccuacuccugggacacaaugaucaaguuaggcgaugucgacacagucgacccccuccgugugcaauggcgaaacaauuccgucaucucacgcccaggccaaucccaaugcccccguuucaacgucugccccgaggucugcugggaaggcacauacaacgaugccuuccucaucgaccgucucaacugggucucagccggagucuaccuaaacuccaaccaaacugcagaaaaccccgucuucgccgucuucaaggacaacgaaauccucuaccaaguaccacuagccgaagacgacaccaacgcucagaaaaccaucacagacugcuuucugcuagaaaacgucauauggugcauuucccucgucgaaauauacgauaccggagacuccgucaucagacccaaacuguuugcagucaaaaucccagcacaaugcuccgaauccuaa

SEQ ID NO: 232 - RNA, 1815 nt, Artificial Sequence
  derived and/or modified CDS sequence (opt11) from Hendra henipavirus__AEQ38115__G
augauggcugacuccaagcuagucucacuaaacaauaaccucucagguaaaauaaaagaccagggcaaagucaucaaaaacuacuacggcaccauggacauaaagaaaaucaacgacggccuccucgacuccaaaauccuaggagccuucaacaccguuauugcccuccuaggcuccaucaucaucaucgucaugaauauaaugaucauccaaaacuacacccgcacaacugacaaccaagcacucaucaaagaaucacuccaauccguccaacaacaaauaaaagcacucaccgacaaaauagguacagaaaucggccccaaagucucacuaaucgacacaucaagcaccaucacgaucccagccaacaucggccuacucggauccaaaauaucccaaucuacaaguuccaucaacgaaaacguaaacgacaagugcaaauucacccuaccaccccugaaaauacaugaaugcaacaucucaugccccaacccccuccccuuccgagaauaccgccccauuucccaaggaguauccgaccucgugggacuacccaaccaaaucugccugcagaaaacaaccuccacaauccuaaaaccccgacucauuucuuacacgcuccccaucaacacgcgagaaggcguaugcauaaccgacccccuauuagcaguugacaacggcuucuucgccuacucccaccuagagaaaaucggcucauguacccgcggcaucgccaagcaacgcauaaucggcguaggcgaaguccuggaccgaggagacaaggucccaagcauguucaugaccaacguuuggaccccacccaaccccuccaccauccaccacugcagcuccaccuaccacgaagacuucuacuacacgcuuugugccgucucucacgucggagaccccauacuuaacuccacauccuggaccgaaucgcugagccugauccgccucgcgguccgacccaaauccgacaacggcgauuacaaccaaaaauacaucgccaucaccaaaguagaacgaggcaaguacgacaaagucaugcccuacggccccuccggcaucaagcaaggcgacacccuauauuucccagccgucggauuccucccccgcacagaguuccaguacaacgacuccaacugccccaucauucacugcaaguacuccaaagcugaaaacugccggcucucaaugggcgucaacuccaaaucgcacuacauacuacguucuggccuccucaaauacaaccucagccuaggaggagacauaauacuccaauucaucgaaaucgcagacaaccgccucaccaucgggucccccucaaaaauauauaacucccucggccagccugucuucuaccaagccuccuacuccugggacaccaugaucaagcucggagacguugacaccguagacccccuccgcguacaguggcgcaacaacuccgucauaagucgccccggacaaucccaaugccccagauucaacgucugcccagaagucugcugggaaggcacguacaacgacgcauuccuuaucgaucgccuaaauugggucuccgcaggagucuaccucaacucuaaccaaaccgcagaaaaccccgucuucgccgucuucaaagacaacgaaauccucuaccaagucccccucgcugaagacgacaccaacgcacagaaaacuaucaccgauugcuuccuacucgaaaacgucaucuggugcaucucacucguagaaauauacgacaccggcgacuccgucauucgccccaaacucuucgcagucaaaaucccagcccaaugcagcgaaucuuag

SEQ ID NO: 233 - RNA, 1815 nt, Artificial Sequence
  derived and/or modified CDS sequence (opt11) from Hendra henipavirus__AEQ38108__G
augauggccgacucaaaacucguaucccucaacaacaaccucuccggcaaaaucaaagaccaaggcaaagucaucaaaaacuacuacggcaccauggacauaaagaaaaucaacgacggccuacucgacuccaaaauacucggcgccuucaacaccgucaucgcacuccucggaagcaucaucaucaucgucaugaacaucaugaucauacaaaacuacacacgaacaaccgacaaccaagcccucauuaaggaaucccuccaaucaguccaacaacaaaucaaagcgcuuacugacaagaucggcaccgaaauaggccccaaagucucccuaauugacaccucaucuacaauaaccauccccgccaacaucggccuccuagggucaaaaaucucucaauccacauccagcauaaacgagaacgucaacgacaagugcaaguucacccuaccaccccucaaaauacacgagugcaacauaagcugccccaacccccuccccuuccgagaguaccgccccauaucacagggagucucagaccucguaggacuacccaaccaaaucugccuucagaaaaccacuuccacuauccuuaaaccccgccucaucuccuauacccuaccuaucaacacccgcgaaggcgucugcaucacggacccccuacuagcagucgacaacggcuucuucgcauacucccaucuugagaaaauaggaagcuguacccgaggcauagccaaacaacgcaucaucggcguuggcgaaguccuagaccgcggcgacaaaguccccucuauguucaugaccaacgucuggacucccccaaaccccucaaccauccaccacugcuccucaaccuaccacgaagacuucuacuacacccuaugcgcagucucucacgucggggacccuauacucaacuccacuucauggaccgaaagccucucccuaauccgccuagccgucaggcccaaauccgacucaggcgacuacaaccaaaaauacaucaccaucaccaaggucgaacgaggcaaauacgacaaagucaugcccuacgggcccuccggcauaaaacaaggcaacacccuauauuuuccagccguuggcuuccuuccccgaacugaguuccaauacaaugacuccaacugcccaauaauccacugcaaauacuccaaagcagaaaacugccgacuauccaugggagucaacucgaaaucgcacuacauccuccgcucuggccucuuaaaauacaaccucucccucggcggagacaucauccuccaguucaucgaaaucgccgacaaccgucucaccaucggauccccauccaaaaucuacaauucccucggccaacccgucuuuuaucaggcauccuauuccugggacaccaugaucaaacuuggugacgucgacaccgucgacccccuacgcguacaauggcggaacaacucagucauaucacgcccaggccaaucccagugcccucgcuucaacgucugcccagaaguaugcugggaaggaaccuacaacgacgccuuccucauagaucgccucaacugggucuccgccggcgucuacuuaaacagcaaccaaacagccgaaaacccaguuuucgccgucuucaaagacaacgaaauccuguaccaaguuccacuagccgaagaugacacaaacgcucagaaaaccauuacagacugcuuucuccucgaaaacgugauauggugcauaucccucgucgaaaucuacgacacgggagacuccgucauccguccaaaacuguucgccgucaaaaucccagcccaauguuccgaauccuag

SEQ ID NO: 234 - RNA, 1815 nt, Artificial Sequence
  derived and/or modified CDS sequence (opt11) from Hendra henipavirus__AAV80426__G
augauggccgacagcaaacuggucucccuaaauaacaaccucuccgguaaaauaaaagaccaaggcaaaguuaucaaaaacuacuacggaacuauggacaucaagaaaaucaacgacggccuacuagacucaaaaauccucggcgcauucaacacggucauagcacuccucggcucaaucaucauaauaguuaugaacaucaugaucauacaaaauuacacccgcaccacagacaaccaagcccucauaaaagaaucccuccaaucaguccaacaacagaucaaagcccugaccgacaaaauaggcacagaaaucggacccaaagucucccuaaucgacaccucauccaccaucacuaucccggcaaacaucggccuccucggcuccaaaaucagccaaugcaccuccucaauaaacgaaaacgucaaugacaaauguaaauuuacccugccgcccuuaaaaauccacgagugcaacaucucaugccccaacccccuccccuuccgcgaauacagacccaucucccaaggcgucucggaccucgucggccuccccaaccaaaucugccuccagaaaaccaccucgaccauucucaagccccgccuaaucuccuacacacucccaauaaauacucgcgagggagucugcaucaccgacccacuacuagccgucgacaacggcuucuuugccuacucccaccuagagaaaaucggcaguugcacccgcggcaucgccaaacaacguauaaucggugucggugaaguacucgacagaggcgacaaaguccccagcauguucaugaccaacgucuggacgcccccaaaccccucaaccauccaccacugcucaucaaccuaccacgaagacuuuuacuacacccucugcgcugucucucacgucggagacccaauccucaacucaacaucauggacagaaagccucagccuaauacgccuagccguccggcccaaauccgacucaggcgacuacaaccaaaaauacauugccauaaccaaagucgaacggggaaaauacgacaaaguuaugcccuauggccccucggggaucaaacaaggagacacccucuacuuccccgcagucggcuuccucccccgcaccgaguuccaauacaacgacuccaacugccccaucauccacugcaaauacagcaaggccgaaaacugccgccuaagcaugggcguaaacuccaagucacacuacauccugcgcucaggacuacugaaauacaaccucucccucggcggagacaucauacuccaauucaucgaaaucgccgacaaccgccuaaccauaggcucccccucaaaaaucuacaacucccuaggccaacccgucuucuaccaagccuccuacucuugggacaccaugauaaaacuaggagacgucgacacugucgacccccuacgcguacaauggcguaacaacucagucaucucccgcccgggccaaagccaaugcccacgcuucaacgucugccccgaaguuugcugggaaggcuccuacaacgacgccuuccuaauagaccgucucaacugggucagcgcaggagucuaccucaacuccaaccaaaccgccgaaaacccugucuuugccguuuucaaggacaacgaaauacucuaccaggucccucucgcagaggacgacaccaacgcacagaaaaccaucaccgacugcuuccugcucgaaaacguaaucuggugcaucucccuugucgaaauauacgacaccggcgacuccgucauacguccaaaacuauucgccguaaaaaucccagcccaaugcuccgaauccuaa

SEQ ID NO: 235 - DNA, 42 bp, Artificial Sequence
  5'-UTR of human ribosomal protein Large 32 lacking the 5' terminal oligopyrimidine tract
ggcgctgcctacggaggtggcagccatctccttctcggcatc

SEQ ID NO: 236 - RNA, 42 nt, Artificial Sequence
  5'-UTR of human ribosomal protein Large 32 lacking the 5' terminal oligopyrimidine tract mRNA
ggcgcugccuacggagguggcagccaucuccuucucggcauc

SEQ ID NO: 237 - DNA, 75 bp, Artificial Sequence
  5'-UTR of human mitochondrial ATP synthase subunit alpha lacking the 5' terminal oligopyrimidine tract
gcggctcggccattttgtcccagtcagtccggaggctgcggctgcagaagtaccgcctgcggagtaactgcaaag

SEQ ID NO: 238 - RNA, 75 nt, Artificial Sequence
  5'-UTR of human mitochondrial ATP synthase subunit alpha lacking the 5' terminal oligopyrimidine tract mRNA
gcggcucggccauuuugucccagucaguccggaggcugcggcugcagaaguaccgccugcggaguaacugcaaag

SEQ ID NO: 239 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 240 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 241 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 242 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 243 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 244 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 245 - DNA, 44 bp, Artificial Sequence
  Center, alpha-complex-binding portion of the 3'-UTR of an alpha-globin gene (muag)
gcccgatgggcctcccaacgggccctcctcccctccttgcaccg

SEQ ID NO: 246 - RNA, 44 nt, Artificial Sequence
  Center, alpha-complex-binding portion of the 3'-UTR of an alpha-globin gene (muag) mRNA
gcccgaugggccucccaacgggcccuccuccccuccuugcaccg

SEQ ID NO: 247 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 248 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 249 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 250 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 251 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 252 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 253 - DNA, 24 bp, Artificial Sequence
  histone stem-loop sequence (histoneSL, hSL)
caaaggctcttttcagagccacca

SEQ ID NO: 254 - RNA, 24 nt, Artificial Sequence
  histone stem-loop sequence (histoneSL, hSL) mRNA
caaaggcucuuuucagagccacca

SEQ ID NO: 255 - DNA, 13 bp, Artificial Sequence
  Kozak
gccgccaccatgg

SEQ ID NO: 256 - RNA, 13 nt, Artificial Sequence
  Kozak mRNA
gccgccaccaugg

SEQ ID NO: 257 - protein, 15 aa, Artificial Sequence
  derived and/or modified protein sequence (wt) from Clostridium tetani__WP_023439719__CLOTE(E88_pE88)-tetX(830-844) (helper peptide)
QYIKANSKFIGITEL

SEQ ID NO: 258 - protein, 24 aa, Artificial Sequence
  derived and/or modified protein sequence (wt) from Homo sapiens__AAA59606__HsHLA-A2(1-24)
MAVMAPRTLVLLLSGALALTQTWA

SEQ ID NO: 259 - protein, 23 aa, Artificial Sequence
  derived and/or modified protein sequence (wt) from Homo sapiens__AAA61213__HsPLAT(1-23)
MDAMKRGLCCVLLLCGAVFVSPS

SEQ ID NO: 260 - protein, 21 aa, Artificial Sequence
  derived and/or modified protein sequence (wt) from Homo sapiens__AAA61213__HsPLAT(1-21)
MDAMKRGLCCVLLLCGAVFVS

SEQ ID NO: 261 - protein, 22 aa, Artificial Sequence
  derived and/or modified protein sequence (wt) from Homo sapiens__AAA61213__HsPLAT(1-22)
MDAMKRGLCCVLLLCGAVFVSP

SEQ ID NO: 262 - protein, 27 aa, Artificial Sequence
  derived and/or modified protein sequence (wt) from Homo sapiens__NP_000790__HsEPO(1-27)
MGVHECPAWLWLLLSLLSLPLGLPVLG

SEQ ID NO: 263 - protein, 18 aa, Artificial Sequence
  derived and/or modified protein sequence (wt) from Homo sapiens__NP_000468__HsALB(1-18)
MKWVTFISLLFLFSSAYS

SEQ ID NO: 264 - protein, 18 aa, Artificial Sequence
  derived and/or modified protein sequence (wt) from Homo sapiens__AAB59424__HsIgE(1-18)
MDWTWILFLVAAATRVHS

SEQ ID NO: 265 - protein, 24 aa, Artificial Sequence
  derived and/or modified protein sequence (wt) from Homo sapiens__NP_055022__HsCD5(1-24)
MPMGSLQPLATLYLLGMLVASCLG

SEQ ID NO: 266 - protein, 20 aa, Artificial Sequence
  derived and/or modified protein sequence (wt) from Homo sapiens__NP_000577__HsIL2(1-20)
MYRMQLLSCIALSLALVTNS

SEQ ID NO: 267 - protein, 18 aa, Artificial Sequence
  derived and/or modified protein sequence (wt) from Homo sapiens__NP_001020371 __HsCTRB2(1-18)
MAFLWLLSCWALLGTTFG

SEQ ID NO: 268 - protein, 19 aa, Artificial Sequence
  derived and/or modified protein sequence (wt) from Homo sapiens__BAC87457__HsIgG-HC(1-19)
MEFGLSWVFLVALFRGVQC

SEQ ID NO: 269 - protein, 19 aa, Artificial Sequence
  derived and/or modified protein sequence (wt) from Homo sapiens__AAA52897__HsIg-HC(1-19)
MDWTWRVFCLLAVTPGAHP

SEQ ID NO: 270 - protein, 19 aa, Artificial Sequence
  derived and/or modified protein sequence (wt) from Homo sapiens__AAA59018__HsIg-LC(1-19)
MAWSPLFLTLITHCAGSWA

SEQ ID NO: 271 - protein, 17 aa, Artificial Sequence
  derived and/or modified protein sequence (wt) from Gaussia princeps__AAG54095__GpLuc(1-17)
MGVKVLFALICIAVAEA

SEQ ID NO: 272 - protein, 21 aa, Artificial Sequence
  derived and/or modified protein sequence (wt) from Mus musculus__BAR42292__MmIgkappa(1-21)
METDTLLLWVLLLWVPGSTGD

SEQ ID NO: 273 - protein, 26 aa, Artificial Sequence
  derived and/or modified protein sequence (wt) from Nepenthes rafflesiana__ABF74624__NrChit1(1-26)
MKTHYSSAILPILTLFVFLSINPSHG

SEQ ID NO: 274 - protein, 21 aa, Artificial Sequence
  derived and/or modified protein sequence (wt) from Conus leopardus__AAS93426__ClLp1.1(1-21)
MGMRMMFIMFMLVVLATTVVS

SEQ ID NO: 275 - protein, 24 aa, Artificial Sequence
  derived and/or modified protein sequence (wt) from Nepenthes gracilis__AB114914__NgNep1(1-24)
MASSLYSFLLALSIVYIFVAPTHS

SEQ ID NO: 276 - protein, 19 aa, Artificial Sequence
  derived and/or modified protein sequence (wt) from Homo sapiens__NP_001691__HsAzu1(1-19)
MTRLTVLALLAGLLASSRA

SEQ ID NO: 277 - protein, 16 aa, Artificial Sequence
  derived and/or modified protein sequence (wt) from Homo sapiens__AAA51948__HsCD33(1-16)
MPLLLLLPLLWAGALA

SEQ ID NO: 278 - protein, 19 aa, Artificial Sequence
  derived and/or modified protein sequence (wt) from Vibrio cholerae__BAA06291__VcCtxB(1-19)
MIKLKFGVFFTVLLSSAYA

SEQ ID NO: 279 - protein, 20 aa, Artificial Sequence
  derived and/or modified protein sequence (wt) from Homo sapiens__NP_001890__HsCST4(1-20)
MARPLCTLLLLMATLAGALA

SEQ ID NO: 280 - protein, 24 aa, Artificial Sequence
  derived and/or modified protein sequence (wt) from Homo sapiens__AAA59172__HsIns-iso1(1-24)
MALWMRLLPLLALLALWGPDPAAA

SEQ ID NO: 281 - protein, 17 aa, Artificial Sequence
  derived and/or modified protein sequence (wt) from Homo sapiens__CAA68724__HsSPARC(1-17)
MRAWIFFLLCLAGRALA

SEQ ID NO: 282 - protein, 17 aa, Artificial Sequence
  derived and/or modified protein sequence (wt) from Inluenza A__ACQ45338__H1N1-HA(1-17)
MKAILVVLLYTFATANA

SEQ ID NO: 283 - protein, 46 aa, Artificial Sequence
  derived and/or modified protein sequence (wt) from Influenza virus____Transmembrane domain of HA
KLESTRIYQILAIYSTVASSLVLVVSLGAISFWMCSNGSLQCRICI

SEQ ID NO: 284 - protein, 17 aa, Artificial Sequence
  derived and/or modified protein sequence (wt) from Human immunodeficiency virus 1__BAF32550__Transmembrane domain of Env
LILGLVIICNASNNLWV

SEQ ID NO: 285 - protein, 22 aa, Artificial Sequence
  derived and/or modified protein sequence (wt) from Human immunodeficiency virus 1__BAF32550__Transmembrane domain of Env
GIGAMIFGFLGAAGSTMGAASI

SEQ ID NO: 286 - protein, 23 aa, Artificial Sequence
  derived and/or modified protein sequence (wt) from Human immunodeficiency virus 1__BAF32550__Transmembrane domain of Env
LWYIRLFIMIVGGLIGLRIIFAV

SEQ ID NO: 287 - protein, 23 aa, Artificial Sequence
  derived and/or modified protein sequence (wt) from Equine infectious anemia virus__AAC03762__Transmembrane domain of Env
AIVAAIVAATAIAASATMSYVAL

SEQ ID NO: 288 - protein, 23 aa, Artificial Sequence
  derived and/or modified protein sequence (wt) from Equine infectious anemia virus__AAC03762__Transmembrane domain of Env
WIPGLGASIIKYIVMFLLIYLLL

SEQ ID NO: 289 - protein, 22 aa, Artificial Sequence
  derived and/or modified protein sequence (wt) from Equine infectious anemia virus__AAC03762__Transmembrane domain of Env
LFWGLVIIVGRIAGYGLRGLAV

SEQ ID NO: 290 - protein, 23 aa, Artificial Sequence
  derived and/or modified protein sequence (wt) from Murine leukemia virus__AAA46526__Transmembrane domain of Env
WFTTLISTIMGPLIVLLLILLLG

SEQ ID NO: 291 - protein, 23 aa, Artificial Sequence
  derived and/or modified protein sequence (wt) from Mouse mammary tumor virus__BAA03768__Transmembrane domain of Env
FVAAIILGISALIAIITSFAVAT

SEQ ID NO: 292 - protein, 23 aa, Artificial Sequence
  derived and/or modified protein sequence (wt) from Mouse mammary tumor virus____Transmembrane domain of Env
YFIFIGVGALLLVIVLMIFPIVF

SEQ ID NO: 293 - protein, 23 aa, Artificial Sequence
  derived and/or modified protein sequence (wt) from Vesicular stomatitis virus__CAA24525__Transmembrane domain of G protein
AVIIGFVILMFLIKLIGVLSSLF

SEQ ID NO: 294 - protein, 20 aa, Artificial Sequence
  derived and/or modified protein sequence (wt) from Rabies virus__AEV43288__Transmembrane domain of G protein
VLMGAGVLTALMLMIFLMTC

SEQ ID NO: 295 - protein, 149 aa, Artificial Sequence
  derived and/or modified protein sequence (wt) from Woodchuck hepatitis virus__NP_671816__VLP forming subunit of WHcAg
DIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 296 - protein, 221 aa, Artificial Sequence
  derived and/or modified protein sequence (wt) from Alfalfa mosaic virus__NP_041195__VLP forming subunit of CP
MSSSQKKAGGKAGKPTKRSQNYAALRKAQLPKPPALKVPVVKPTNTILPQTGCVWQSLGTPLSLSSFNGLGVRFLYSFLKDFAGPRILEEDLIYRMVFSITPSYAGTFCLTDDVTTEDGRAVAHGNPMQEFPHGAFHANEKFGFELVFTAPTHAGMQNQNFKHSYAVALCLDFDAQPEGSKNPSYRFNEVWVERKAFPRAGPLRSLITVGLLDEADDLDRH

SEQ ID NO: 297 - protein, 9 aa, Artificial Sequence
  derived and/or modified protein sequence (artificial) from Artificial____peptide linker 1
GGGGSGGGG

SEQ ID NO: 298 - protein, 14 aa, Artificial Sequence
  derived and/or modified protein sequence (artificial) from Artificial____peptide linker 2
GGGGSGGGGSGGGG

SEQ ID NO: 299 - protein, 5 aa, Artificial Sequence
  derived and/or modified protein sequence (artificial) from Artificial____peptide linker 3
GSGSG

SEQ ID NO: 300 - protein, 22 aa, Artificial Sequence
  derived and/or modified protein sequence (wt) from Foot-and-mouth disease virus____F2Amod1
VKQTLNFDLLKLAGDVESNPGP

SEQ ID NO: 301 - protein, 22 aa, Artificial Sequence
  derived and/or modified protein sequence (wt) from Foot-and-mouth disease virus____F2Amod2
VKQTLNFDLLKLAGDVESNPGP

SEQ ID NO: 302 - RNA, 66 nt, Artificial Sequence
  derived and/or modified CDS sequence (wt) from Foot-and-mouth disease virus____F2Amod1
gugaagcagacacucaauuucgaccuucugaaguuggcuggagauguugagucuaacccaggcccc

SEQ ID NO: 303 - RNA, 66 nt, Artificial Sequence
  derived and/or modified CDS sequence (wt) from Foot-and-mouth disease virus____F2Amod2
gucaaacagaccuugaacuucgacuugcucaaacuggccggggauguggaguccaauccuggaccu

SEQ ID NO: 304 - RNA, 671 nt, Artificial Sequence
  derived and/or modified CDS sequence (wt) from Encephalomyocarditis virus____EMCV-IRES-4
uugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuacc

SEQ ID NO: 305 - RNA, 461 nt, Artificial Sequence
  derived and/or modified CDS sequence (wt) from Foot-and-mouth disease virus____FMDV-IRES
agcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccu

SEQ ID NO: 306 - protein, 14 aa, Artificial Sequence
  carrier peptide 1
CRRRRRRRRRRRRC

SEQ ID NO: 307 - protein, 13 aa, Artificial Sequence
  carrier peptide 2
CRRRRRRRRRRRR

SEQ ID NO: 308 - protein, 14 aa, Artificial Sequence
  carrier peptide 3
WRRRRRRRRRRRRC

SEQ ID NO: 309 - protein, 18 aa, Artificial Sequence
  carrier peptide 4
CHHHHHHRRRRHHHHHHC

SEQ ID NO: 310 - protein, 25 aa, Artificial Sequence
  derived and/or modified protein sequence (wt) from Homo sapiens__CAA23783__HsMHCII(1-25)
MAISGVPVLGFFIIAVLMSAQESWA

SEQ ID NO: 311 - protein, 26 aa, Artificial Sequence
  derived and/or modified protein sequence (wt) from Nipah henipavirus__AAK50553__F(1-26)
MVVILDKRCYCNLLILILMISECSVG

SEQ ID NO: 312 - protein, 26 aa, Artificial Sequence
  derived and/or modified protein sequence (wt) from Nipah henipavirus__AEZ01388__F(1-26)
MAVILNKRYYSNLLILILIISECSVG

SEQ ID NO: 313 - protein, 26 aa, Artificial Sequence
  derived and/or modified protein sequence (wt) from Nipah henipavirus__AAY43915__F(1-26)
MAVILNKRYYSNLLILILMISECSVG

SEQ ID NO: 314 - protein, 26 aa, Artificial Sequence
  derived and/or modified protein sequence (wt) from Nipah henipavirus__CBM41033__F(1-26)
MVVILDKRCYSNLLILILMISECSVG

SEQ ID NO: 315 - protein, 26 aa, Artificial Sequence
  derived and/or modified protein sequence (wt) from Hendra henipavirus__NP_047111__F(1-26)
MATQEVRLKCLLCGIIVLVLSLEGLG

SEQ ID NO: 316 - protein, 25 aa, Artificial Sequence
  derived and/or modified protein sequence (wt) from Hendra henipavirus__AEQ38114__F(1-25)
MATQEVRLKCLLCGIIVLVLSLEGL

SEQ ID NO: 317 - RNA, 72 nt, Artificial Sequence
  derived and/or modified CDS sequence (wt) from Homo sapiens__AAA59606__HsHLA-A2(1-24)
auggccgucauggcgccccgaacccucguccugcuacucucgggggcucuggcccugacccagaccugggcg

SEQ ID NO: 318 - RNA, 69 nt, Artificial Sequence
  derived and/or modified CDS sequence (wt) from Homo sapiens__AAA61213__HsPLAT(1-23)
auggaugcaaugaagagagggcucugcugugugcugcugcuguguggagcagucuucguuucgcccagc

SEQ ID NO: 319 - RNA, 63 nt, Artificial Sequence
  derived and/or modified CDS sequence (wt) from Homo sapiens__AAA61213__HsPLAT(1-21)
auggaugcaaugaagagagggcucugcugugugcugcugcuguguggagcagucuucguuucg

SEQ ID NO: 320 - RNA, 66 nt, Artificial Sequence
  derived and/or modified CDS sequence (wt) from Homo sapiens__AAA61213__HsPLAT(1-22)
auggaugcaaugaagagagggcucugcugugugcugcugcuguguggagcagucuucguuucgccc

SEQ ID NO: 321 - RNA, 81 nt, Artificial Sequence
  derived and/or modified CDS sequence (wt) from Homo sapiens__NP_000790__HsEPO(1-27)
augggggugcacgaauguccugccuggcuguggcuucuccugucccugcugucgcucccucugggccucccaguccugggc

SEQ ID NO: 322 - RNA, 54 nt, Artificial Sequence
  derived and/or modified CDS sequence (wt) from Homo sapiens__NP_000468__HsALB(1-18)
augaaguggguaaccuuuauuucccuucuuuuucucuuuagcucggcuuauucc

SEQ ID NO: 323 - RNA, 54 nt, Artificial Sequence
  derived and/or modified CDS sequence (wt) from Homo sapiens__AAB59424__HsIgE(1-18)
auggacuggaccuggauccuguuccucguggccgccgcgacccgcguccacagc

SEQ ID NO: 324 - RNA, 72 nt, Artificial Sequence
  derived and/or modified CDS sequence (wt) from Homo sapiens__NP_055022__HsCD5(1-24)
augcccauggggucucugcaaccgcuggccaccuuguaccugcuggggaugcuggucgcuuccugccucgga

SEQ ID NO: 325 - RNA, 60 nt, Artificial Sequence
  derived and/or modified CDS sequence (wt) from Homo sapiens__NP_000577__HsIL2(1-20)
auguacaggaugcaacuccugucuugcauugcacuaagucuugcacuugucacaaacagu

SEQ ID NO: 326 - RNA, 54 nt, Artificial Sequence
  derived and/or modified CDS sequence (wt) from Homo sapiens__NP_001020371 __HsCTRB2(1-18)
auggcuuuccucuggcuccucuccugcugggcccuccuggguaccaccuucggc

SEQ ID NO: 327 - RNA, 57 nt, Artificial Sequence
  derived and/or modified CDS sequence (wt) from Homo sapiens__BAC87457__HsIgG-HC(1-19)
auggaguuugggcugagcuggguuuuccucguugcucuuuuuagagguguccagugu

SEQ ID NO: 328 - RNA, 57 nt, Artificial Sequence
  derived and/or modified CDS sequence (wt) from Homo sapiens__AAA52897__HsIGH@-HC(1-19)
auggacuggaccuggagggucuucuguuugcuggcuguaacuccaggcgcccacccc

SEQ ID NO: 329 - RNA, 57 nt, Artificial Sequence
  derived and/or modified CDS sequence (wt) from Homo sapiens__AAA59018__HsIGL@-LC(1-19)
auggccugguccccucucuuccucacccucaucacucacugugcaggguccugggcc

SEQ ID NO: 330 - RNA, 51 nt, Artificial Sequence
  derived and/or modified CDS sequence (wt) from Gaussia princeps__AAG54095__GpLuc(1-17)
augggagugaaaguucuuuuugcccuuauuuguauugcuguggccgaggcc

SEQ ID NO: 331 - RNA, 63 nt, Artificial Sequence
  derived and/or modified CDS sequence (wt) from Mus musculus__BAR42292__MmIgkappa(1-21)
auggagacagacacacuccugcuaugggugcugcugcucuggguuccagguuccacaggugac

SEQ ID NO: 332 - RNA, 78 nt, Artificial Sequence
  derived and/or modified CDS sequence (wt) from Nepenthes rafflesiana__ABF74624__NrChit1(1-26)
augaagacccauuauucaucagcaauucucccgauccucacccucuucgucuuucucucgaucaauccaucccauggc

SEQ ID NO: 333 - RNA, 63 nt, Artificial Sequence
  derived and/or modified CDS sequence (wt) from Conus leopardus__AAS93426__ClLp1.1(1-21)
augggcaugcggaugauguucaucauguuuaugcugguugucuuggcaaccacugucguuucc

SEQ ID NO: 334 - RNA, 72 nt, Artificial Sequence
  derived and/or modified CDS sequence (wt) from Nepenthes gracilis__AB114914__NgNep1(1-24)
auggccucgucgcuguauucuuucuuacucgcauuaucgauaguuuacaucuuuguugccccaacacauucu

SEQ ID NO: 335 - RNA, 57 nt, Artificial Sequence
  derived and/or modified CDS sequence (wt) from Homo sapiens__NP_001691__HsAzu1(1-19)
augacccggcugacaguccuggcccugcuggcuggucugcuggcguccucgagggcc

SEQ ID NO: 336 - RNA, 48 nt, Artificial Sequence
  derived and/or modified CDS sequence (wt) from Homo sapiens__AAA51948__HsCD33(1-16)
augccgcugcugcuacugcugccccugcugugggcaggggcccuggcu

SEQ ID NO: 337 - RNA, 57 nt, Artificial Sequence
  derived and/or modified CDS sequence (wt) from Vibrio cholerae__BAA06291__VcCtxB(1-19)
augauuaaauuaaaauuugguguuuuuuuuacaguuuuacuaucuucagcauaugca

SEQ ID NO: 338 - RNA, 60 nt, Artificial Sequence
  derived and/or modified CDS sequence (wt) from Homo sapiens__NP_001890__HsCST4(1-20)
auggcccggccucuguguacccugcuacuccugauggcuacccuggcuggggcucuggcc

SEQ ID NO: 339 - RNA, 72 nt, Artificial Sequence
  derived and/or modified CDS sequence (wt) from Homo sapiens__AAA59172__HsIns-iso1(1-24)
auggcccuguggaugcgccuccugccccugcuggcgcugcuggcccucuggggaccugacccagccgcagcc

SEQ ID NO: 340 - RNA, 51 nt, Artificial Sequence
  derived and/or modified CDS sequence (wt) from Homo sapiens__CAA68724__HsSPARC(1-17)
augagggccuggaucuucuuucuccuuugccuggccgggagggcucuggca

SEQ ID NO: 341 - RNA, 51 nt, Artificial Sequence
  derived and/or modified CDS sequence (wt) from Inluenza A__ACQ45338__H1N1-HA(1-17)
augaaggcaauacuaguaguucugcuauauacauuugcaaccgcaaaugca

SEQ ID NO: 342 - RNA, 75 nt, Artificial Sequence
  derived and/or modified CDS sequence (wt) from Homo sapiens__CAA23783__HsMHCII(1-25)
auggccauaaguggagucccugugcuaggauuuuucaucauagcugugcugaugagcgcucaggaaucaugggcu

SEQ ID NO: 343 - RNA, 78 nt, Artificial Sequence
  derived and/or modified CDS sequence (wt) from Nipah henipavirus__AAK50553__F(1-26)
augguaguuauacuugacaagagauguuauuguaaucuuuuaauauugauuuugaugaucucggaguguaguguuggg

SEQ ID NO: 344 - RNA, 78 nt, Artificial Sequence
  derived and/or modified CDS sequence (wt) from Nipah henipavirus__AEZ01388__F(1-26)
auggcagucauacuuaacaagagauauuauucuaaucucuuaauacugauuuugauaaucucggagugcagugucggg

SEQ ID NO: 345 - RNA, 78 nt, Artificial Sequence
  derived and/or modified CDS sequence (wt) from Nipah henipavirus__AAY43915__F(1-26)
auggcaguuauacuuaacaagagauauuauucuaaucucuuaauacugauuuugaugaucucggagugcagugucggg

SEQ ID NO: 346 - RNA, 78 nt, Artificial Sequence
  derived and/or modified CDS sequence (wt) from Nipah henipavirus__CBM41033__F(1-26)
augguaguuauacuugacaagagauguuauucuaaucuuuuaauauugauuuugaugaucucggaguguaguguuggg

SEQ ID NO: 347 - RNA, 78 nt, Artificial Sequence
  derived and/or modified CDS sequence (wt) from Hendra henipavirus__NP_047111__F(1-26)
auggcuacacaagaggucaggcuaaaguguuugcucugugggaucauaguucugguuuugucauuagaagggcuaggg

SEQ ID NO: 348 - RNA, 75 nt, Artificial Sequence
  derived and/or modified CDS sequence (wt) from Hendra henipavirus__AEQ38114__F(1-25)
auggcuacacaagaggucaggcuaaaguguuugcucugugggaucauaguucugguuuugucauuagaagggcua

SEQ ID NO: 349 - RNA, 72 nt, Artificial Sequence
  derived and/or modified CDS sequence (opt1) from Homo sapiens__AAA59606__HsHLA-A2(1-24)
auggccgugauggccccgcggacccugguccuccugcugagcggcgcgcucgcccugacccagacgugggcc

SEQ ID NO: 350 - RNA, 69 nt, Artificial Sequence
  derived and/or modified CDS sequence (opt1) from Homo sapiens__AAA61213__HsPLAT(1-23)
auggacgccaugaagcgcggccugugcugcgugcuccugcugugcggggccgucuucgugagccccucc

SEQ ID NO: 351 - RNA, 63 nt, Artificial Sequence
  derived and/or modified CDS sequence (opt1) from Homo sapiens__AAA61213__HsPLAT(1-21)
auggacgccaugaagcgcggccugugcugcgugcuccugcugugcggggccgucuucgugagc

SEQ ID NO: 352 - RNA, 66 nt, Artificial Sequence
  derived and/or modified CDS sequence (opt1) from Homo sapiens__AAA61213__HsPLAT(1-22)
auggacgccaugaagcgcggccugugcugcgugcuccugcugugcggggccgucuucgugagcccc

SEQ ID NO: 353 - RNA, 81 nt, Artificial Sequence
  derived and/or modified CDS sequence (opt1) from Homo sapiens__NP_000790__HsEPO(1-27)
augggcgugcacgagugccccgccuggcuguggcuccugcugagccuccugucccugccgcucgggcugcccguccugggc

SEQ ID NO: 354 - RNA, 54 nt, Artificial Sequence
  derived and/or modified CDS sequence (opt1) from Homo sapiens__NP_000468__HsALB(1-18)
augaagugggugaccuucaucagccugcucuuccuguucuccagcgccuacucc

SEQ ID NO: 355 - RNA, 54 nt, Artificial Sequence; identical to SEQ ID NO: 323
  derived and/or modified CDS sequence (opt1) from Homo sapiens__AAB59424__HsIgE(1-18)

SEQ ID NO: 356 - RNA, 72 nt, Artificial Sequence
  derived and/or modified CDS sequence (opt1) from Homo sapiens__NP_055022__HsCD5(1-24)
augcccaugggcagccugcagccgcucgccacccuguaccugcucgggaugcugguggccuccugccugggc

SEQ ID NO: 357 - RNA, 60 nt, Artificial Sequence
  derived and/or modified CDS sequence (opt1) from Homo sapiens__NP_000577__HsIL2(1-20)
auguaccggaugcagcugcucagcugcaucgcccugucgcuggcgcucgugaccaacagc

SEQ ID NO: 358 - RNA, 54 nt, Artificial Sequence
  derived and/or modified CDS sequence (opt1) from Homo sapiens__NP_001020371 __HsCTRB2(1-18)
auggccuuccuguggcuccugagcugcugggcccugcucggcaccaccuucggg

SEQ ID NO: 359 - RNA, 57 nt, Artificial Sequence
  derived and/or modified CDS sequence (opt1) from Homo sapiens__BAC87457__HsIgG-HC(1-19)
auggaguucggccugagcuggguguuccucgucgcccuguuccgcggggugcagugc

SEQ ID NO: 360 - RNA, 57 nt, Artificial Sequence
  derived and/or modified CDS sequence (opt1) from Homo sapiens__AAA52897__HsIGH@-HC(1-19)
auggacuggaccuggcgcguguucugccugcucgccgucacccccggcgcccacccg

SEQ ID NO: 361 - RNA, 57 nt, Artificial Sequence
  derived and/or modified CDS sequence (opt1) from Homo sapiens__AAA59018__HsIGL@-LC(1-19)
auggccuggagcccccuguuccucacccugaucacccacugcgccggcuccugggcg

SEQ ID NO: 362 - RNA, 51 nt, Artificial Sequence
  derived and/or modified CDS sequence (opt1) from Gaussia princeps__AAG54095__GpLuc(1-17)
augggcgugaagguccuguucgcccucaucugcaucgccguggcggaggcc

SEQ ID NO: 363 - RNA, 63 nt, Artificial Sequence
  derived and/or modified CDS sequence (opt1) from Mus musculus__BAR42292__MmIgkappa(1-21)
auggagaccgacacccugcuccugugggugcugcuccuguggguccccggcagcacgggggac

SEQ ID NO: 364 - RNA, 78 nt, Artificial Sequence
  derived and/or modified CDS sequence (opt1) from Nepenthes rafflesiana__ABF74624__NrChit1(1-26)
augaagacccacuacagcuccgccauccugcccauccucacccuguucguguuccugagcaucaacccgucccacggc

SEQ ID NO: 365 - RNA, 63 nt, Artificial Sequence
  derived and/or modified CDS sequence (opt1) from Conus leopardus__AAS93426__ClLp1.1(1-21)
augggcaugcgcaugauguucaucauguucaugcuggugguccucgccaccaccguggugagc

SEQ ID NO: 366 - RNA, 72 nt, Artificial Sequence
  derived and/or modified CDS sequence (opt1) from Nepenthes gracilis__AB114914__NgNep1(1-24)
auggccagcucccuguacagcuuccuccuggcccuguccaucguguacaucuucgucgcgcccacccacagc

SEQ ID NO: 367 - RNA, 57 nt, Artificial Sequence
  derived and/or modified CDS sequence (opt1) from Homo sapiens__NP_001691__HsAzu1(1-19)
augacccgccugaccgugcucgcccugcuggccggccuccuggcgagcucccgggcc

SEQ ID NO: 368 - RNA, 48 nt, Artificial Sequence
  derived and/or modified CDS sequence (opt1) from Homo sapiens__AAA51948__HsCD33(1-16)
augccccugcuccugcugcucccgcugcugugggccggcgcccucgcg

SEQ ID NO: 369 - RNA, 57 nt, Artificial Sequence
  derived and/or modified CDS sequence (opt1) from Vibrio cholerae__BAA06291__VcCtxB(1-19)
augaucaagcugaaguucggcguguucuucaccguccuccugagcuccgccuacgcc

SEQ ID NO: 370 - RNA, 60 nt, Artificial Sequence
  derived and/or modified CDS sequence (opt1) from Homo sapiens__NP_001890__HsCST4(1-20)
auggcccgcccccugugcacccuccugcugcucauggccacccuggcgggcgcccuggcc

SEQ ID NO: 371 - RNA, 72 nt, Artificial Sequence
  derived and/or modified CDS sequence (opt1) from Homo sapiens__AAA59172__HsIns-iso1(1-24)
auggcccuguggaugcgccuccugccccugcucgcccugcuggcgcucuggggcccggaccccgccgccgcc

SEQ ID NO: 372 - RNA, 51 nt, Artificial Sequence
  derived and/or modified CDS sequence (opt1) from Homo sapiens__CAA68724__HsSPARC(1-17)
augcgcgccuggaucuucuuccugcucugccuggccggccgggcccuggcc

SEQ ID NO: 373 - RNA, 51 nt, Artificial Sequence
  derived and/or modified CDS sequence (opt1) from Inluenza A__ACQ45338__H1N1-HA(1-17)
augaaggccauccuggugguccuccuguacaccuucgccaccgcgaacgcc

SEQ ID NO: 374 - RNA, 75 nt, Artificial Sequence
  derived and/or modified CDS sequence (opt1) from Homo sapiens__CAA23783__HsMHCII(1-25)
auggccaucagcggcgugcccguccugggguucuucaucaucgccgugcucauguccgcgcaggagagcugggcc

SEQ ID NO: 375 - RNA, 78 nt, Artificial Sequence
  derived and/or modified CDS sequence (opt1) from Nipah henipavirus__AAK50553__F(1-26)
augguggucauccuggacaagcgcugcuacugcaaccuccugauccugauccucaugaucagcgagugcuccgugggc

SEQ ID NO: 376 - RNA, 78 nt, Artificial Sequence
  derived and/or modified CDS sequence (opt1) from Nipah henipavirus__AEZ01388__F(1-26)
auggccgugauccugaacaagcgcuacuacagcaaccuccugauccugauccucaucaucuccgagugcagcgucggc

SEQ ID NO: 377 - RNA, 78 nt, Artificial Sequence
  derived and/or modified CDS sequence (opt1) from Nipah henipavirus__AAY43915__F(1-26)
auggccgugauccugaacaagcgcuacuacagcaaccuccugauccugauccucaugaucuccgagugcagcgucggc

SEQ ID NO: 378 - RNA, 78 nt, Artificial Sequence
  derived and/or modified CDS sequence (opt1) from Nipah henipavirus__CBM41033__F(1-26)
augguggucauccuggacaagcgcugcuacagcaaccuccugauccugauccucaugaucuccgagugcagcgugggc

SEQ ID NO: 379 - RNA, 78 nt, Artificial Sequence
  derived and/or modified CDS sequence (opt1) from Hendra henipavirus__NP_047111__F(1-26)
auggccacccaggaggugcgccugaagugccuccugugcggcaucaucguccuggugcucagccuggaggggcugggc

SEQ ID NO: 380 - RNA, 75 nt, Artificial Sequence
  derived and/or modified CDS sequence (opt1) from Hendra henipavirus__AEQ38114__F(1-25)
auggccacccaggaggugcgccugaagugccuccugugcggcaucaucguccuggugcucagccuggaggggcug

SEQ ID NO: 381 - RNA, 72 nt, Artificial Sequence
  derived and/or modified CDS sequence (opt2) from Homo sapiens__AAA59606__HsHLA-A2(1-24)
auggccgucauggccccccgcacccucguccuccuccucuccggcgcccucgcccucacccagaccugggcc

SEQ ID NO: 382 - RNA, 69 nt, Artificial Sequence
  derived and/or modified CDS sequence (opt2) from Homo sapiens__AAA61213__HsPLAT(1-23)
auggacgccaugaagcgcggccucugcugcguccuccuccucugcggcgccgucuucgucucccccucc

SEQ ID NO: 383 - RNA, 63 nt, Artificial Sequence
  derived and/or modified CDS sequence (opt2) from Homo sapiens__AAA61213__HsPLAT(1-21)
auggacgccaugaagcgcggccucugcugcguccuccuccucugcggcgccgucuucgucucc

SEQ ID NO: 384 - RNA, 66 nt, Artificial Sequence
  derived and/or modified CDS sequence (opt2) from Homo sapiens__AAA61213__HsPLAT(1-22)
auggacgccaugaagcgcggccucugcugcguccuccuccucugcggcgccgucuucgucuccccc

SEQ ID NO: 385 - RNA, 81 nt, Artificial Sequence
  derived and/or modified CDS sequence (opt2) from Homo sapiens__NP_000790__HsEPO(1-27)
augggcguccacgagugccccgccuggcucuggcuccuccucucccuccucucccucccccucggccuccccguccucggc

SEQ ID NO: 386 - RNA, 54 nt, Artificial Sequence
  derived and/or modified CDS sequence (opt2) from Homo sapiens__NP_000468__HsALB(1-18)
augaagugggucaccuucaucucccuccucuuccucuucuccuccgccuacucc

SEQ ID NO: 387 - RNA, 54 nt, Artificial Sequence
  derived and/or modified CDS sequence (opt2) from Homo sapiens__AAB59424__HsIgE(1-18)
auggacuggaccuggauccucuuccucgucgccgccgccacccgcguccacucc

SEQ ID NO: 388 - RNA, 72 nt, Artificial Sequence
  derived and/or modified CDS sequence (opt2) from Homo sapiens__NP_055022__HsCD5(1-24)
augcccaugggcucccuccagccccucgccacccucuaccuccucggcaugcucgucgccuccugccucggc

SEQ ID NO: 389 - RNA, 60 nt, Artificial Sequence
  derived and/or modified CDS sequence (opt2) from Homo sapiens__NP_000577__HsIL2(1-20)
auguaccgcaugcagcuccucuccugcaucgcccucucccucgcccucgucaccaacucc

SEQ ID NO: 390 - RNA, 54 nt, Artificial Sequence
  derived and/or modified CDS sequence (opt2) from Homo sapiens__NP_001020371 __HsCTRB2(1-18)
auggccuuccucuggcuccucuccugcugggcccuccucggcaccaccuucggc

SEQ ID NO: 391 - RNA, 57 nt, Artificial Sequence
  derived and/or modified CDS sequence (opt2) from Homo sapiens__BAC87457__HsIgG-HC(1-19)
auggaguucggccucuccugggucuuccucgucgcccucuuccgcggcguccagugc

SEQ ID NO: 392 - RNA, 57 nt, Artificial Sequence
  derived and/or modified CDS sequence (opt2) from Homo sapiens__AAA52897__HsIGH@-HC(1-19)
auggacuggaccuggcgcgucuucugccuccucgccgucacccccggcgcccacccc

SEQ ID NO: 393 - RNA, 57 nt, Artificial Sequence
  derived and/or modified CDS sequence (opt2) from Homo sapiens__AAA59018__HsIGL@-LC(1-19)
auggccugguccccccucuuccucacccucaucacccacugcgccggcuccugggcc

SEQ ID NO: 394 - RNA, 51 nt, Artificial Sequence
  derived and/or modified CDS sequence (opt2) from Gaussia princeps__AAG54095__GpLuc(1-17)
augggcgucaagguccucuucgcccucaucugcaucgccgucgccgaggcc

SEQ ID NO: 395 - RNA, 63 nt, Artificial Sequence
  derived and/or modified CDS sequence (opt2) from Mus musculus__BAR42292__MmIgkappa(1-21)
auggagaccgacacccuccuccucuggguccuccuccucuggguccccggcuccaccggcgac

SEQ ID NO: 396 - RNA, 78 nt, Artificial Sequence
  derived and/or modified CDS sequence (opt2) from Nepenthes rafflesiana__ABF74624__NrChit1(1-26)
augaagacccacuacuccuccgccauccuccccauccucacccucuucgucuuccucuccaucaaccccucccacggc

SEQ ID NO: 397 - RNA, 63 nt, Artificial Sequence
  derived and/or modified CDS sequence (opt2) from Conus leopardus__AAS93426__ClLp1.1(1-21)
augggcaugcgcaugauguucaucauguucaugcucgucguccucgccaccaccgucgucucc

SEQ ID NO: 398 - RNA, 72 nt, Artificial Sequence
  derived and/or modified CDS sequence (opt2) from Nepenthes gracilis__AB114914__NgNep1(1-24)
auggccuccucccucuacuccuuccuccucgcccucuccaucgucuacaucuucgucgcccccacccacucc

SEQ ID NO: 399 - RNA, 57 nt, Artificial Sequence
  derived and/or modified CDS sequence (opt2) from Homo sapiens__NP_001691__HsAzu1(1-19)
augacccgccucaccguccucgcccuccucgccggccuccucgccuccucccgcgcc

SEQ ID NO: 400 - RNA, 48 nt, Artificial Sequence
  derived and/or modified CDS sequence (opt2) from Homo sapiens__AAA51948__HsCD33(1-16)
augccccuccuccuccuccucccccuccucugggccggcgcccucgcc

SEQ ID NO: 401 - RNA, 57 nt, Artificial Sequence
  derived and/or modified CDS sequence (opt2) from Vibrio cholerae__BAA06291__VcCtxB(1-19)
augaucaagcucaaguucggcgucuucuucaccguccuccucuccuccgccuacgcc

SEQ ID NO: 402 - RNA, 60 nt, Artificial Sequence
  derived and/or modified CDS sequence (opt2) from Homo sapiens__NP_001890__HsCST4(1-20)
auggcccgcccccucugcacccuccuccuccucauggccacccucgccggcgcccucgcc

SEQ ID NO: 403 - RNA, 72 nt, Artificial Sequence
  derived and/or modified CDS sequence (opt2) from Homo sapiens__AAA59172__HsIns-iso1(1-24)
auggcccucuggaugcgccuccucccccuccucgcccuccucgcccucuggggccccgaccccgccgccgcc

SEQ ID NO: 404 - RNA, 51 nt, Artificial Sequence
  derived and/or modified CDS sequence (opt2) from Homo sapiens__CAA68724__HsSPARC(1-17)
augcgcgccuggaucuucuuccuccucugccucgccggccgcgcccucgcc

SEQ ID NO: 405 - RNA, 51 nt, Artificial Sequence
  derived and/or modified CDS sequence (opt2) from Inluenza A__ACQ45338__H1N1-HA(1-17)
augaaggccauccucgucguccuccucuacaccuucgccaccgccaacgcc

SEQ ID NO: 406 - RNA, 75 nt, Artificial Sequence
  derived and/or modified CDS sequence (opt2) from Homo sapiens__CAA23783__HsMHCII(1-25)
auggccaucuccggcguccccguccucggcuucuucaucaucgccguccucauguccgcccaggaguccugggcc

SEQ ID NO: 407 - RNA, 78 nt, Artificial Sequence
  derived and/or modified CDS sequence (opt2) from Nipah henipavirus__AAK50553__F(1-26)
auggucgucauccucgacaagcgcugcuacugcaaccuccucauccucauccucaugaucuccgagugcuccgucggc

SEQ ID NO: 408 - RNA, 78 nt, Artificial Sequence
  derived and/or modified CDS sequence (opt2) from Nipah henipavirus__AEZ01388__F(1-26)
auggccgucauccucaacaagcgcuacuacuccaaccuccucauccucauccucaucaucuccgagugcuccgucggc

SEQ ID NO: 409 - RNA, 78 nt, Artificial Sequence
  derived and/or modified CDS sequence (opt2) from Nipah henipavirus__AAY43915__F(1-26)
auggccgucauccucaacaagcgcuacuacuccaaccuccucauccucauccucaugaucuccgagugcuccgucggc

SEQ ID NO: 410 - RNA, 78 nt, Artificial Sequence
  derived and/or modified CDS sequence (opt2) from Nipah henipavirus__CBM41033__F(1-26)
auggucgucauccucgacaagcgcugcuacuccaaccuccucauccucauccucaugaucuccgagugcuccgucggc

SEQ ID NO: 411 - RNA, 78 nt, Artificial Sequence
  derived and/or modified CDS sequence (opt2) from Hendra henipavirus__NP_047111__F(1-26)
auggccacccaggagguccgccucaagugccuccucugcggcaucaucguccucguccucucccucgagggccucggc

SEQ ID NO: 412 - RNA, 75 nt, Artificial Sequence
  derived and/or modified CDS sequence (opt2) from Hendra henipavirus__AEQ38114__F(1-25)
auggccacccaggagguccgccucaagugccuccucugcggcaucaucguccucguccucucccucgagggccuc

SEQ ID NO: 413 - RNA, 72 nt, Artificial Sequence
  derived and/or modified CDS sequence (opt3) from Homo sapiens__AAA59606__HsHLA-A2(1-24)
auggccgugauggcucccagaacccugguccuccuucugagcggcgcauuggccuuaacacagacuugggcg

SEQ ID NO: 414 - RNA, 69 nt, Artificial Sequence
  derived and/or modified CDS sequence (opt3) from Homo sapiens__AAA61213__HsPLAT(1-23)
auggacgccaugaagagaggccugugcugugugcuccuucugugcggggcugucuucguuagccccucc

SEQ ID NO: 415 - RNA, 63 nt, Artificial Sequence
  derived and/or modified CDS sequence (opt3) from Homo sapiens__AAA61213__HsPLAT(1-21)
auggacgccaugaagagaggccugugcugugugcuccuucugugcggggcugucuucguuagc

SEQ ID NO: 416 - RNA, 66 nt, Artificial Sequence
  derived and/or modified CDS sequence (opt3) from Homo sapiens__AAA61213__HsPLAT(1-22)
auggacgccaugaagagaggccugugcugugugcuccuucugugcggggcugucuucguuagcccc

SEQ ID NO: 417 - RNA, 81 nt, Artificial Sequence
  derived and/or modified CDS sequence (opt3) from Homo sapiens__NP_000790__HsEPO(1-27)
augggcgugcacgagugccccgccuggcuguggcuccuucugagcuuguuaucccugccucuagggcucccaguccuggga

SEQ ID NO: 418 - RNA, 54 nt, Artificial Sequence
  derived and/or modified CDS sequence (opt3) from Homo sapiens__NP_000468__HsALB(1-18)
augaagugggugaccuucaucagccugcucuuucuuuucuccucugccuacuca

SEQ ID NO: 419 - RNA, 54 nt, Artificial Sequence
  derived and/or modified CDS sequence (opt3) from Homo sapiens__AAB59424__HsIgE(1-18)
auggacuggaccuggauccuguuccucguggccgcugcaacaagaguccacagc

SEQ ID NO: 420 - RNA, 72 nt, Artificial Sequence
  derived and/or modified CDS sequence (opt3) from Homo sapiens__NP_055022__HsCD5(1-24)
augcccaugggcagccugcagccucucgccacccuuuaccuguuggggauguuaguggcuuccugccuggga

SEQ ID NO: 421 - RNA, 60 nt, Artificial Sequence
  derived and/or modified CDS sequence (opt3) from Homo sapiens__NP_000577__HsIL2(1-20)
auguacagaaugcagcugcucagcugcaucgcccuuucccuggcuuuggugaccaacucu

SEQ ID NO: 422 - RNA, 54 nt, Artificial Sequence
  derived and/or modified CDS sequence (opt3) from Homo sapiens__NP_001020371 __HsCTRB2(1-18)
auggccuuccuguggcuccuuagcugcugggcucuguugggcaccacauuuggg

SEQ ID NO: 423 - RNA, 57 nt, Artificial Sequence
  derived and/or modified CDS sequence (opt3) from Homo sapiens__BAC87457__HsIgG-HC(1-19)
auggaguucggccugagcuggguguuucucgucgcccuuuucagagggguucagugc

SEQ ID NO: 424 - RNA, 57 nt, Artificial Sequence
  derived and/or modified CDS sequence (opt3) from Homo sapiens__AAA52897__HsIGH@-HC(1-19)
auggacuggaccuggagaguguucugccugcucgccgucacacccggcgcucacccu

SEQ ID NO: 425 - RNA, 57 nt, Artificial Sequence
  derived and/or modified CDS sequence (opt3) from Homo sapiens__AAA59018__HsIGL@-LC(1-19)
auggccuggagcccccuguuccucacccuuaucacacacugcgcuggcuccugggca

SEQ ID NO: 426 - RNA, 51 nt, Artificial Sequence
  derived and/or modified CDS sequence (opt3) from Gaussia princeps__AAG54095__GpLuc(1-17)
augggcgugaagguccuguucgcccucaucugcauugcuguugcagaggcc

SEQ ID NO: 427 - RNA, 63 nt, Artificial Sequence
  derived and/or modified CDS sequence (opt3) from Mus musculus__BAR42292__MmIgkappa(1-21)
auggagaccgacacacugcuccuuugggugcuguuguuauggguccccggcagcacuggggau

SEQ ID NO: 428 - RNA, 78 nt, Artificial Sequence
  derived and/or modified CDS sequence (opt3) from Nepenthes rafflesiana__ABF74624__NrChit1(1-26)
augaagacccacuacagcuccgccauccugcccauucucacacuuuucguguuucugucuauaaacccuucacauggc

SEQ ID NO: 429 - RNA, 63 nt, Artificial Sequence
  derived and/or modified CDS sequence (opt3) from Conus leopardus__AAS93426__ClLp1.1(1-21)
augggcaugagaaugauguucaucauguuuaugcuggugguccucgccaccacaguugugagc

SEQ ID NO: 430 - RNA, 72 nt, Artificial Sequence
  derived and/or modified CDS sequence (opt3) from Nepenthes gracilis__AB114914__NgNep1(1-24)
auggccagcucccuguacucuuuccuccuugcucugucaaucguguauauuuuugucgcacccacccacagu

SEQ ID NO: 431 - RNA, 57 nt, Artificial Sequence
  derived and/or modified CDS sequence (opt3) from Homo sapiens__NP_001691__HsAzu1(1-19)
augaccagacugacagugcucgcccuucuggcuggcuuguuagcaagcuccagggcc

SEQ ID NO: 432 - RNA, 48 nt, Artificial Sequence
  derived and/or modified CDS sequence (opt3) from Homo sapiens__AAA51948__HsCD33(1-16)
augccccugcuccuucuguugccuuuacugugggccggcgcucuagca

SEQ ID NO: 433 - RNA, 57 nt, Artificial Sequence
  derived and/or modified CDS sequence (opt3) from Vibrio cholerae__BAA06291__VcCtxB(1-19)
augaucaagcugaaauucggcguguuuuucaccguccuccuuagcuccgccuacgcu

SEQ ID NO: 434 - RNA, 60 nt, Artificial Sequence
  derived and/or modified CDS sequence (opt3) from Homo sapiens__NP_001890__HsCST4(1-20)
auggccagaccccugugcacccuccuucuguugauggcuacauuagcaggcgcccuggcg

SEQ ID NO: 435 - RNA, 72 nt, Artificial Sequence
  derived and/or modified CDS sequence (opt3) from Homo sapiens__AAA59172__HsIns-iso1(1-24)
auggcccuguggaugagacuccuuccccuguuggcuuuacuggcacuauggggcccugacccagccgcggcu

SEQ ID NO: 436 - RNA, 51 nt, Artificial Sequence
  derived and/or modified CDS sequence (opt3) from Homo sapiens__CAA68724__HsSPARC(1-17)
augagagccuggaucuucuuucugcucugccuugcuggcagggcacuggcc

SEQ ID NO: 437 - RNA, 51 nt, Artificial Sequence
  derived and/or modified CDS sequence (opt3) from Inluenza A__ACQ45338__H1N1-HA(1-17)
augaaggccauccuggugguccuccuuuacaccuucgcuacagcaaacgcc

SEQ ID NO: 438 - RNA, 75 nt, Artificial Sequence
  derived and/or modified CDS sequence (opt3) from Homo sapiens__CAA23783__HsMHCII(1-25)
auggccaucagcggcgugcccguccugggguucuuuauuauagcuguucucauguccgcacaggagucuugggcc

SEQ ID NO: 439 - RNA, 78 nt, Artificial Sequence
  derived and/or modified CDS sequence (opt3) from Nipah henipavirus__AAK50553__F(1-26)
augguggucauccuggacaagagaugcuacuguaaccuccuuauucugauauugaugaucagcgagugcuccguuggc

SEQ ID NO: 440 - RNA, 78 nt, Artificial Sequence
  derived and/or modified CDS sequence (opt3) from Nipah henipavirus__AEZ01388__F(1-26)
auggccgugauccugaacaagagauacuauagcaaucuccuuauucugauauugaucauuuccgagugcucugucggc

SEQ ID NO: 441 - RNA, 78 nt, Artificial Sequence
  derived and/or modified CDS sequence (opt3) from Nipah henipavirus__AAY43915__F(1-26)
auggccgugauccugaacaagagauacuauagcaaucuccuuauucugauauugaugaucuccgagugcucugucggc

SEQ ID NO: 442 - RNA, 78 nt, Artificial Sequence
  derived and/or modified CDS sequence (opt3) from Nipah henipavirus__CBM41033__F(1-26)
augguggucauccuggacaagagaugcuacagcaaccuccuuauucugauauugaugaucuccgaguguucuguuggc

SEQ ID NO: 443 - RNA, 78 nt, Artificial Sequence
  derived and/or modified CDS sequence (opt3) from Hendra henipavirus__NP_047111__F(1-26)
auggccacccaggaggugagacugaagugccuccuuuguggcaucauuguccugguuuugagcuuagaagggcuggga

SEQ ID NO: 444 - RNA, 75 nt, Artificial Sequence
  derived and/or modified CDS sequence (opt3) from Hendra henipavirus__AEQ38114__F(1-25)
auggccacccaggaggugagacugaagugccuccuuuguggcaucauuguccugguuuugagcuuagaagggcug

SEQ ID NO: 445 - RNA, 72 nt, Artificial Sequence
  derived and/or modified CDS sequence (opt4) from Homo sapiens__AAA59606__HsHLA-A2(1-24)
auggccgugauggcccccagaacccuggugcugcugcugagcggcgcccuggcccugacccagaccugggcc

SEQ ID NO: 446 - RNA, 69 nt, Artificial Sequence
  derived and/or modified CDS sequence (opt4) from Homo sapiens__AAA61213__HsPLAT(1-23)
auggacgccaugaagagaggccugugcugcgugcugcugcugugcggcgccguguucgugagccccagc

SEQ ID NO: 447 - RNA, 63 nt, Artificial Sequence
  derived and/or modified CDS sequence (opt4) from Homo sapiens__AAA61213__HsPLAT(1-21)
auggacgccaugaagagaggccugugcugcgugcugcugcugugcggcgccguguucgugagc

SEQ ID NO: 448 - RNA, 66 nt, Artificial Sequence
  derived and/or modified CDS sequence (opt4) from Homo sapiens__AAA61213__HsPLAT(1-22)
auggacgccaugaagagaggccugugcugcgugcugcugcugugcggcgccguguucgugagcccc

SEQ ID NO: 449 - RNA, 81 nt, Artificial Sequence
  derived and/or modified CDS sequence (opt4) from Homo sapiens__NP_000790__HsEPO(1-27)
augggcgugcacgagugccccgccuggcuguggcugcugcugagccugcugagccugccccugggccugcccgugcugggc

SEQ ID NO: 450 - RNA, 54 nt, Artificial Sequence
  derived and/or modified CDS sequence (opt4) from Homo sapiens__NP_000468__HsALB(1-18)
augaagugggugaccuucaucagccugcuguuccuguucagcagcgccuacagc

SEQ ID NO: 451 - RNA, 54 nt, Artificial Sequence
  derived and/or modified CDS sequence (opt4) from Homo sapiens__AAB59424__HsIgE(1-18)
auggacuggaccuggauccuguuccugguggccgccgccaccagagugcacagc

SEQ ID NO: 452 - RNA, 72 nt, Artificial Sequence
  derived and/or modified CDS sequence (opt4) from Homo sapiens__NP_055022__HsCD5(1-24)
augcccaugggcagccugcagccccuggccacccuguaccugcugggcaugcugguggccagcugccugggc

SEQ ID NO: 453 - RNA, 60 nt, Artificial Sequence
  derived and/or modified CDS sequence (opt4) from Homo sapiens__NP_000577__HsIL2(1-20)
auguacagaaugcagcugcugagcugcaucgcccugagccuggcccuggugaccaacagc

SEQ ID NO: 454 - RNA, 54 nt, Artificial Sequence
  derived and/or modified CDS sequence (opt4) from Homo sapiens__NP_001020371 __HsCTRB2(1-18)
auggccuuccuguggcugcugagcugcugggcccugcugggcaccaccuucggc

SEQ ID NO: 455 - RNA, 57 nt, Artificial Sequence
  derived and/or modified CDS sequence (opt4) from Homo sapiens__BAC87457__HsIgG-HC(1-19)
auggaguucggccugagcuggguguuccugguggcccuguucagaggcgugcagugc

SEQ ID NO: 456 - RNA, 57 nt, Artificial Sequence
  derived and/or modified CDS sequence (opt4) from Homo sapiens__AAA52897__HsIGH@-HC(1-19)
auggacuggaccuggagaguguucugccugcuggccgugacccccggcgcccacccc

SEQ ID NO: 457 - RNA, 57 nt, Artificial Sequence
  derived and/or modified CDS sequence (opt4) from Homo sapiens__AAA59018__HsIGL@-LC(1-19)
auggccuggagcccccuguuccugacccugaucacccacugcgccggcagcugggcc

SEQ ID NO: 458 - RNA, 51 nt, Artificial Sequence
  derived and/or modified CDS sequence (opt4) from Gaussia princeps__AAG54095__GpLuc(1-17)
augggcgugaaggugcuguucgcccugaucugcaucgccguggccgaggcc

SEQ ID NO: 459 - RNA, 63 nt, Artificial Sequence
  derived and/or modified CDS sequence (opt4) from Mus musculus__BAR42292__MmIgkappa(1-21)
auggagaccgacacccugcugcugugggugcugcugcugugggugcccggcagcaccggcgac

SEQ ID NO: 460 - RNA, 78 nt, Artificial Sequence
  derived and/or modified CDS sequence (opt4) from Nepenthes rafflesiana__ABF74624__NrChit1(1-26)
augaagacccacuacagcagcgccauccugcccauccugacccuguucguguuccugagcaucaaccccagccacggc

SEQ ID NO: 461 - RNA, 63 nt, Artificial Sequence
  derived and/or modified CDS sequence (opt4) from Conus leopardus__AAS93426__ClLp1.1(1-21)
augggcaugagaaugauguucaucauguucaugcugguggugcuggccaccaccguggugagc

SEQ ID NO: 462 - RNA, 72 nt, Artificial Sequence
  derived and/or modified CDS sequence (opt4) from Nepenthes gracilis__AB114914__NgNep1(1-24)
auggccagcagccuguacagcuuccugcuggcccugagcaucguguacaucuucguggcccccacccacagc

SEQ ID NO: 463 - RNA, 57 nt, Artificial Sequence
  derived and/or modified CDS sequence (opt4) from Homo sapiens__NP_001691__HsAzu1(1-19)
augaccagacugaccgugcuggcccugcuggccggccugcuggccagcagcagagcc

SEQ ID NO: 464 - RNA, 48 nt, Artificial Sequence
  derived and/or modified CDS sequence (opt4) from Homo sapiens__AAA51948__HsCD33(1-16)
augccccugcugcugcugcugccccugcugugggccggcgcccuggcc

SEQ ID NO: 465 - RNA, 57 nt, Artificial Sequence
  derived and/or modified CDS sequence (opt4) from Vibrio cholerae__BAA06291__VcCtxB(1-19)
augaucaagcugaaguucggcguguucuucaccgugcugcugagcagcgccuacgcc

SEQ ID NO: 466 - RNA, 60 nt, Artificial Sequence
  derived and/or modified CDS sequence (opt4) from Homo sapiens__NP_001890__HsCST4(1-20)
auggccagaccccugugcacccugcugcugcugauggccacccuggccggcgcccuggcc

SEQ ID NO: 467 - RNA, 72 nt, Artificial Sequence
  derived and/or modified CDS sequence (opt4) from Homo sapiens__AAA59172__HsIns-iso1(1-24)
auggcccuguggaugagacugcugccccugcuggcccugcuggcccuguggggccccgaccccgccgccgcc

SEQ ID NO: 468 - RNA, 51 nt, Artificial Sequence
  derived and/or modified CDS sequence (opt4) from Homo sapiens__CAA68724__HsSPARC(1-17)
augagagccuggaucuucuuccugcugugccuggccggcagagcccuggcc

SEQ ID NO: 469 - RNA, 51 nt, Artificial Sequence
  derived and/or modified CDS sequence (opt4) from Inluenza A__ACQ45338__H1N1-HA(1-17)
augaaggccauccugguggugcugcuguacaccuucgccaccgccaacgcc

SEQ ID NO: 470 - RNA, 75 nt, Artificial Sequence
  derived and/or modified CDS sequence (opt4) from Homo sapiens__CAA23783__HsMHCII(1-25)
auggccaucagcggcgugcccgugcugggcuucuucaucaucgccgugcugaugagcgcccaggagagcugggcc

SEQ ID NO: 471 - RNA, 78 nt, Artificial Sequence
  derived and/or modified CDS sequence (opt4) from Nipah henipavirus__AAK50553__F(1-26)
augguggugauccuggacaagagaugcuacugcaaccugcugauccugauccugaugaucagcgagugcagcgugggc

SEQ ID NO: 472 - RNA, 78 nt, Artificial Sequence
  derived and/or modified CDS sequence (opt4) from Nipah henipavirus__AEZ01388__F(1-26)
auggccgugauccugaacaagagauacuacagcaaccugcugauccugauccugaucaucagcgagugcagcgugggc

SEQ ID NO: 473 - RNA, 78 nt, Artificial Sequence
  derived and/or modified CDS sequence (opt4) from Nipah henipavirus__AAY43915__F(1-26)
auggccgugauccugaacaagagauacuacagcaaccugcugauccugauccugaugaucagcgagugcagcgugggc

SEQ ID NO: 474 - RNA, 78 nt, Artificial Sequence
  derived and/or modified CDS sequence (opt4) from Nipah henipavirus__CBM41033__F(1-26)
augguggugauccuggacaagagaugcuacagcaaccugcugauccugauccugaugaucagcgagugcagcgugggc

SEQ ID NO: 475 - RNA, 78 nt, Artificial Sequence
  derived and/or modified CDS sequence (opt4) from Hendra henipavirus__NP_047111__F(1-26)
auggccacccaggaggugagacugaagugccugcugugcggcaucaucgugcuggugcugagccuggagggccugggc

SEQ ID NO: 476 - RNA, 75 nt, Artificial Sequence
  derived and/or modified CDS sequence (opt4) from Hendra henipavirus__AEQ38114__F(1-25)
auggccacccaggaggugagacugaagugccugcugugcggcaucaucgugcuggugcugagccuggagggccug

SEQ ID NO: 477 - RNA, 72 nt, Artificial Sequence
  derived and/or modified CDS sequence (opt5) from Homo sapiens__AAA59606__HsHLA-A2(1-24)
auggccgugauggcucccagaacccugguccuccugcuuagcggcgcccuggcgcucacacagacgugggcu

SEQ ID NO: 478 - RNA, 69 nt, Artificial Sequence
  derived and/or modified CDS sequence (opt5) from Homo sapiens__AAA61213__HsPLAT(1-23)
auggacgccaugaagagaggccugugcugugugcuccugcuuugcggggcugucuucguuagccccucc

SEQ ID NO: 479 - RNA, 63 nt, Artificial Sequence
  derived and/or modified CDS sequence (opt5) from Homo sapiens__AAA61213__HsPLAT(1-21)
auggacgccaugaagagaggccugugcugugugcuccugcuuugcggggcugucuucguuagc

SEQ ID NO: 480 - RNA, 66 nt, Artificial Sequence
  derived and/or modified CDS sequence (opt5) from Homo sapiens__AAA61213__HsPLAT(1-22)
auggacgccaugaagagaggccugugcugugugcuccugcuuugcggggcugucuucguuagcccc

SEQ ID NO: 481 - RNA, 81 nt, Artificial Sequence
  derived and/or modified CDS sequence (opt5) from Homo sapiens__NP_000790__HsEPO(1-27)
augggcgugcacgagugccccgccuggcuguggcuccugcuuagccugcucucccugccucuugggcugccgguccucgga

SEQ ID NO: 482 - RNA, 54 nt, Artificial Sequence
  derived and/or modified CDS sequence (opt5) from Homo sapiens__NP_000468__HsALB(1-18)
augaagugggugaccuucaucagccugcucuuucuguucuccucugccuacagc

SEQ ID NO: 483 - RNA, 54 nt, Artificial Sequence
  derived and/or modified CDS sequence (opt5) from Homo sapiens__AAB59424__HsIgE(1-18)
auggacuggaccuggauccuguuccucguggccgcugccacaagaguccacagc

SEQ ID NO: 484 - RNA, 72 nt, Artificial Sequence
  derived and/or modified CDS sequence (opt5) from Homo sapiens__NP_055022__HsCD5(1-24)
augcccaugggcagccugcagccucucgccacccuguaccuucuggggaugcucguggcuuccugccuggga

SEQ ID NO: 485 - RNA, 60 nt, Artificial Sequence
  derived and/or modified CDS sequence (opt5) from Homo sapiens__NP_000577__HsIL2(1-20)
auguacagaaugcagcugcucagcugcaucgcccugucccuugcucuggugaccaacucu

SEQ ID NO: 486 - RNA, 54 nt, Artificial Sequence
  derived and/or modified CDS sequence (opt5) from Homo sapiens__NP_001020371 __HsCTRB2(1-18)
auggcuuuccuguggcuccugagcugcugggcccuucugggcaccacauuuggg

SEQ ID NO: 487 - RNA, 57 nt, Artificial Sequence
  derived and/or modified CDS sequence (opt5) from Homo sapiens__BAC87457__HsIgG-HC(1-19)
auggaguucggccugagcuggguguuucucgucgcccuguucagagggguucagugc

SEQ ID NO: 488 - RNA, 57 nt, Artificial Sequence; identical to SEQ ID NO: 424
  derived and/or modified CDS sequence (opt5) from Homo sapiens__AAA52897__HsIGH@-HC(1-19)

SEQ ID NO: 489 - RNA, 57 nt, Artificial Sequence
  derived and/or modified CDS sequence (opt5) from Homo sapiens__AAA59018__HsIGL@-LC(1-19)
auggccuggagcccccuguuccucacccugaucacacacugcgcuggcuccugggcc

SEQ ID NO: 490 - RNA, 51 nt, Artificial Sequence
  derived and/or modified CDS sequence (opt5) from Gaussia princeps__AAG54095__GpLuc(1-17)
augggcgugaagguccuguucgcccucaucugcauugcuguugccgaggcg

SEQ ID NO: 491 - RNA, 63 nt, Artificial Sequence
  derived and/or modified CDS sequence (opt5) from Mus musculus__BAR42292__MmIgkappa(1-21)
auggagaccgacacacugcuccugugggugcuucugcucuggguccccggcagcacgggggau

SEQ ID NO: 492 - RNA, 78 nt, Artificial Sequence
  derived and/or modified CDS sequence (opt5) from Nepenthes rafflesiana__ABF74624__NrChit1(1-26)
augaagacccacuacagcuccgccauccugcccauucucacacuguucguguuucuuucuaucaacccuagccauggc

SEQ ID NO: 493 - RNA, 63 nt, Artificial Sequence; identical to SEQ ID NO: 429
  derived and/or modified CDS sequence (opt5) from Conus leopardus__AAS93426__ClLp1.1(1-21)

SEQ ID NO: 494 - RNA, 72 nt, Artificial Sequence
  derived and/or modified CDS sequence (opt5) from Nepenthes gracilis__AB114914__NgNep1(1-24)
auggccagcucccuguacucuuuccuccuggcucuuagcaucguguauauuuuugucgcccccacccacucc

SEQ ID NO: 495 - RNA, 57 nt, Artificial Sequence
  derived and/or modified CDS sequence (opt5) from Homo sapiens__NP_001691__HsAzu1(1-19)
augaccagacugacagugcucgcccugcuugcuggccugcucgccagcucccgggcg

SEQ ID NO: 496 - RNA, 48 nt, Artificial Sequence
  derived and/or modified CDS sequence (opt5) from Homo sapiens__AAA51948__HsCD33(1-16)
augccccugcuccugcuucugccucuccugugggccggcgcucuugcc

SEQ ID NO: 497 - RNA, 57 nt, Artificial Sequence
  derived and/or modified CDS sequence (opt5) from Vibrio cholerae__BAA06291__VcCtxB(1-19)
augaucaagcugaaauucggcguguuuuucaccguccuccugagcuccgccuacgcu

SEQ ID NO: 498 - RNA, 60 nt, Artificial Sequence
  derived and/or modified CDS sequence (opt5) from Homo sapiens__NP_001890__HsCST4(1-20)
auggccagaccccugugcacccuccugcuucugauggcuacacucgccggcgcgcuggcu

SEQ ID NO: 499 - RNA, 72 nt, Artificial Sequence
  derived and/or modified CDS sequence (opt5) from Homo sapiens__AAA59172__HsIns-iso1(1-24)
auggcccuguggaugagacuccugccccuucuggcucuccuggcccuuuggggcccugacccggcggcugcc

SEQ ID NO: 500 - RNA, 51 nt, Artificial Sequence
  derived and/or modified CDS sequence (opt5) from Homo sapiens__CAA68724__HsSPARC(1-17)
augagagccuggaucuucuuucugcucugccuggcuggccgggcccuugcg

SEQ ID NO: 501 - RNA, 51 nt, Artificial Sequence
  derived and/or modified CDS sequence (opt5) from Inluenza A__ACQ45338__H1N1-HA(1-17)
augaaggccauccuggugguccuccuguacaccuucgcuacagccaacgcg

SEQ ID NO: 502 - RNA, 75 nt, Artificial Sequence
  derived and/or modified CDS sequence (opt5) from Homo sapiens__CAA23783__HsMHCII(1-25)
auggccaucagcggcgugcccguccugggguucuuuauuaucgcuguucucauguccgcccaggagucuugggcg

SEQ ID NO: 503 - RNA, 78 nt, Artificial Sequence
  derived and/or modified CDS sequence (opt5) from Nipah henipavirus__AAK50553__F(1-26)
augguggucauccuggacaagagaugcuacuguaaccuccugauucuuauccugaugauuagcgagugcuccguuggc

SEQ ID NO: 504 - RNA, 78 nt, Artificial Sequence
  derived and/or modified CDS sequence (opt5) from Nipah henipavirus__AEZ01388__F(1-26)
auggccgugauccugaacaagagauacuauagcaaucuccugauucuuauccugauuaucuccgagugcucugucggc

SEQ ID NO: 505 - RNA, 78 nt, Artificial Sequence
  derived and/or modified CDS sequence (opt5) from Nipah henipavirus__AAY43915__F(1-26)
auggccgugauccugaacaagagauacuauagcaaucuccugauucuuauccugaugauuuccgagugcucugucggc

SEQ ID NO: 506 - RNA, 78 nt, Artificial Sequence
  derived and/or modified CDS sequence (opt5) from Nipah henipavirus__CBM41033__F(1-26)
augguggucauccuggacaagagaugcuacagcaaccuccugauucuuauccugaugauuuccgaguguucuguuggc

SEQ ID NO: 507 - RNA, 78 nt, Artificial Sequence
  derived and/or modified CDS sequence (opt5) from Hendra henipavirus__NP_047111__F(1-26)
auggccacccaggaggugagacugaagugccuccuguguggcaucauuguccuuguucugagccucgaagggcuggga

SEQ ID NO: 508 - RNA, 75 nt, Artificial Sequence
  derived and/or modified CDS sequence (opt5) from Hendra henipavirus__AEQ38114__F(1-25)
auggccacccaggaggugagacugaagugccuccuguguggcaucauuguccuuguucugagccucgaagggcug

SEQ ID NO: 509 - RNA, 72 nt, Artificial Sequence
  derived and/or modified CDS sequence (opt6) from Homo sapiens__AAA59606__HsHLA-A2(1-24)
auggcaguaauggcaccaagaacauuaguacuacuacuaucaggagcacuagcacuaacacaaacaugggca

SEQ ID NO: 510 - RNA, 69 nt, Artificial Sequence
  derived and/or modified CDS sequence (opt6) from Homo sapiens__AAA61213__HsPLAT(1-23)
auggaugcuaugaaaagagguuuauguuguguuuuauuauuauguggagcuguauuuguaaguccaagu

SEQ ID NO: 511 - RNA, 63 nt, Artificial Sequence
  derived and/or modified CDS sequence (opt6) from Homo sapiens__AAA61213__HsPLAT(1-21)
auggaugcgaugaagagaggguuauguuguguguuauuguuauguggagcgguauuuguaagu

SEQ ID NO: 512 - RNA, 66 nt, Artificial Sequence
  derived and/or modified CDS sequence (opt6) from Homo sapiens__AAA61213__HsPLAT(1-22)
auggaugcaaugaaaagaggauuauguuguguauuauuauuauguggagcaguauuuguaagucca

SEQ ID NO: 513 - RNA, 81 nt, Artificial Sequence
  derived and/or modified CDS sequence (opt6) from Homo sapiens__NP_000790__HsEPO(1-27)
auggguguacaugaauguccagcuuggcuuuggcuuuuacuuucacuuuuaucuuuaccuuuagguuuaccuguacuugga

SEQ ID NO: 514 - RNA, 54 nt, Artificial Sequence
  derived and/or modified CDS sequence (opt6) from Homo sapiens__NP_000468__HsALB(1-18)
augaaauggguuacuuuuauuucucuucuuuuucuuuuuucuucugcuuacucu

SEQ ID NO: 515 - RNA, 54 nt, Artificial Sequence
  derived and/or modified CDS sequence (opt6) from Homo sapiens__AAB59424__HsIgE(1-18)
auggacuggacauggauauuauuuuuaguagcagcagcaacaagaguacauuca

SEQ ID NO: 516 - RNA, 72 nt, Artificial Sequence
  derived and/or modified CDS sequence (opt6) from Homo sapiens__NP_055022__HsCD5(1-24)
augccuauggguucacuucaaccuuuagcuacacuuuaucuuuuagguaugcuuguagcuucauguuuaggu

SEQ ID NO: 517 - RNA, 60 nt, Artificial Sequence
  derived and/or modified CDS sequence (opt6) from Homo sapiens__NP_000577__HsIL2(1-20)
auguaccguaugcaacuacuuucauguauagcucuaucucuagcucuaguuacaaauuca

SEQ ID NO: 518 - RNA, 54 nt, Artificial Sequence
  derived and/or modified CDS sequence (opt6) from Homo sapiens__NP_001020371 __HsCTRB2(1-18)
auggcuuuuuuaugguuauuaucuuguugggcuuuauuagguacuacuuuuggu

SEQ ID NO: 519 - RNA, 57 nt, Artificial Sequence
  derived and/or modified CDS sequence (opt6) from Homo sapiens__BAC87457__HsIgG-HC(1-19)
auggaauuugguuuaucuuggguuuuuuuaguugcuuuauuuagagguguucagugu

SEQ ID NO: 520 - RNA, 57 nt, Artificial Sequence
  derived and/or modified CDS sequence (opt6) from Homo sapiens__AAA52897__HsIGH@-HC(1-19)
auggauuggacuuggcguguauuuuguuuauuagcuguaacuccaggugcacaucca

SEQ ID NO: 521 - RNA, 57 nt, Artificial Sequence
  derived and/or modified CDS sequence (opt6) from Homo sapiens__AAA59018__HsIGL@-LC(1-19)
auggccuggaguccauuauuuuuaacauuaauaacucauugugcaggcucaugggca

SEQ ID NO: 522 - RNA, 51 nt, Artificial Sequence
  derived and/or modified CDS sequence (opt6) from Gaussia princeps__AAG54095__GpLuc(1-17)
augggaguaaaaguacuauuugcauuaauauguauagcaguagcagaagca

SEQ ID NO: 523 - RNA, 63 nt, Artificial Sequence
  derived and/or modified CDS sequence (opt6) from Mus musculus__BAR42292__MmIgkappa(1-21)
auggaaacagauacauuauuauuauggguuuuauuauuauggguaccuggaaguacaggugac

SEQ ID NO: 524 - RNA, 78 nt, Artificial Sequence
  derived and/or modified CDS sequence (opt6) from Nepenthes rafflesiana__ABF74624__NrChit1(1-26)
augaaaacacacuacuccucagccauacucccaauccuaacccuauucguauuccuauccauaaacccaucccacggc

SEQ ID NO: 525 - RNA, 63 nt, Artificial Sequence
  derived and/or modified CDS sequence (opt6) from Conus leopardus__AAS93426__ClLp1.1(1-21)
augggaaugagaaugauguuuauaauguucaugcuaguaguauuagcaacaacaguaguauca

SEQ ID NO: 526 - RNA, 72 nt, Artificial Sequence
  derived and/or modified CDS sequence (opt6) from Nepenthes gracilis__AB114914__NgNep1(1-24)
auggccucaucucuauauucauuucuacuugcacuuucaauuguauauauauuuguagccccaacucacucu

SEQ ID NO: 527 - RNA, 57 nt, Artificial Sequence
  derived and/or modified CDS sequence (opt6) from Homo sapiens__NP_001691__HsAzu1(1-19)
augacaagacuaacaguauuagcauuacuagcaggauuacuagcaagcucaagagca

SEQ ID NO: 528 - RNA, 48 nt, Artificial Sequence
  derived and/or modified CDS sequence (opt6) from Homo sapiens__AAA51948__HsCD33(1-16)
augccuuuauuauuauuauuaccuuuacuuugggcuggcgcuuuagcu

SEQ ID NO: 529 - RNA, 57 nt, Artificial Sequence
  derived and/or modified CDS sequence (opt6) from Vibrio cholerae__BAA06291__VcCtxB(1-19)
augauuaagcuuaaguuugggguuuuuuuuacgguuuugcuuucgagugcguaugcg

SEQ ID NO: 530 - RNA, 60 nt, Artificial Sequence
  derived and/or modified CDS sequence (opt6) from Homo sapiens__NP_001890__HsCST4(1-20)
auggcuagaccucuauguacauuacuauuacuaauggcaacucuagcuggagcucuagcu

SEQ ID NO: 531 - RNA, 72 nt, Artificial Sequence
  derived and/or modified CDS sequence (opt6) from Homo sapiens__AAA59172__HsIns-iso1(1-24)
auggcauuauggaugagauuauuaccauuauuagcauuauuagcauuauggggaccagauccagcagcagca

SEQ ID NO: 532 - RNA, 51 nt, Artificial Sequence
  derived and/or modified CDS sequence (opt6) from Homo sapiens__CAA68724__HsSPARC(1-17)
augcgugcauggauauuuuuucuuuuauguuuggcuggacgugcacuugca

SEQ ID NO: 533 - RNA, 51 nt, Artificial Sequence
  derived and/or modified CDS sequence (opt6) from Inluenza A__ACQ45338__H1N1-HA(1-17)
augaaagcaaucuuagucguacucuuauacacauucgcgaccgcaaacgca

SEQ ID NO: 534 - RNA, 75 nt, Artificial Sequence
  derived and/or modified CDS sequence (opt6) from Homo sapiens__CAA23783__HsMHCII(1-25)
auggcaauuucagguguaccuguacuuggauuuuuuauuauagcuguauuaaugagugcacaagaaaguugggcc

SEQ ID NO: 535 - RNA, 78 nt, Artificial Sequence
  derived and/or modified CDS sequence (opt6) from Nipah henipavirus__AAK50553__F(1-26)
augguugucauacuagacaaaagaugcuacugcaauuuacuaauucuuauacuaaugauaucugaauguucuguagga

SEQ ID NO: 536 - RNA, 78 nt, Artificial Sequence
  derived and/or modified CDS sequence (opt6) from Nipah henipavirus__AEZ01388__F(1-26)
auggcaguaauacuaaacaaaagauauuacucaaaccuacucauacucauccuaaucauaucagaaugcucagucggc

SEQ ID NO: 537 - RNA, 78 nt, Artificial Sequence
  derived and/or modified CDS sequence (opt6) from Nipah henipavirus__AAY43915__F(1-26)
auggcaguaauacuaaauaagagauacuacucaaaccuacuaauacuaaucuuaaugaucucagaauguuccguagga

SEQ ID NO: 538 - RNA, 78 nt, Artificial Sequence
  derived and/or modified CDS sequence (opt6) from Nipah henipavirus__CBM41033__F(1-26)
augguaguaauacucgacaaaagaugcuacuccaaccuacucauacuaauuuuaaugauaucagaauguucuguagga

SEQ ID NO: 539 - RNA, 78 nt, Artificial Sequence
  derived and/or modified CDS sequence (opt6) from Hendra henipavirus__NP_047111__F(1-26)
auggccacccaagaaguucgacuaaaauguuuacuaugcggaauaauaguccuaguacucucucuagaaggauuagga

SEQ ID NO: 540 - RNA, 75 nt, Artificial Sequence
  derived and/or modified CDS sequence (opt6) from Hendra henipavirus__AEQ38114__F(1-25)
auggcaacacaagaaguacgacucaaaugccuauuaugcggaauaauaguauuaguacuaucccuagaaggacua

SEQ ID NO: 541 - RNA, 72 nt, Artificial Sequence
  derived and/or modified CDS sequence (opt11) from Homo sapiens__AAA59606__HsHLA-A2(1-24)
auggccgucauggccccccgcacccucguccuccuccucuccggcgcccucgcccucacccaaaccugggcc

SEQ ID NO: 542 - RNA, 69 nt, Artificial Sequence
  derived and/or modified CDS sequence (opt11) from Homo sapiens__AAA61213__HsPLAT(1-23)
auggacgccaugaaacgcggccucugcugcguccuccuccucugcggcgccgucuucgucucccccucc

SEQ ID NO: 543 - RNA, 63 nt, Artificial Sequence
  derived and/or modified CDS sequence (opt11) from Homo sapiens__AAA61213__HsPLAT(1-21)
auggacgcgaugaagcgcgggcucuguugcgugcucuugcucuguggcgcggucuuugucucg

SEQ ID NO: 544 - RNA, 66 nt, Artificial Sequence
  derived and/or modified CDS sequence (opt11) from Homo sapiens__AAA61213__HsPLAT(1-22)
auggaugcgaugaagaggggguuguguuguguguuguuguuguguggggcgguguuugugaguccg

SEQ ID NO: 545 - RNA, 81 nt, Artificial Sequence
  derived and/or modified CDS sequence (opt11) from Homo sapiens__NP_000790__HsEPO(1-27)
augggcgugcacgagugcccggccuggcucuggcucuugcucucgcucuugagcuugcccuugggcuugcccgugcucggg

SEQ ID NO: 546 - RNA, 54 nt, Artificial Sequence
  derived and/or modified CDS sequence (opt11) from Homo sapiens__NP_000468__HsALB(1-18)
augaaaugggucaccuucaucucccuccucuuccucuucuccuccgccuacucc

SEQ ID NO: 547 - RNA, 54 nt, Artificial Sequence
  derived and/or modified CDS sequence (opt11) from Homo sapiens__AAB59424__HsIgE(1-18)
auggauuggacguggauacucuuucucguggccgcggccacgcgcgugcacucg

SEQ ID NO: 548 - RNA, 72 nt, Artificial Sequence
  derived and/or modified CDS sequence (opt11) from Homo sapiens__NP_055022__HsCD5(1-24)
augcccaugggcucccuccaaccccucgccacccucuaccuccucggcaugcucgucgccuccugccucggc

SEQ ID NO: 549 - RNA, 60 nt, Artificial Sequence
  derived and/or modified CDS sequence (opt11) from Homo sapiens__NP_000577__HsIL2(1-20)
auguaccgcaugcaacuccucuccugcaucgcccucucccucgcccucgucaccaacucc

SEQ ID NO: 550 - RNA, 54 nt, Artificial Sequence; identical to SEQ ID NO: 390
  derived and/or modified CDS sequence (opt11) from Homo sapiens__NP_001020371 __HsCTRB2(1-18)

SEQ ID NO: 551 - RNA, 57 nt, Artificial Sequence
  derived and/or modified CDS sequence (opt11) from Homo sapiens__BAC87457__HsIgG-HC(1-19)
auggaguucgggcucucguggguguucuuggucgcgcucuuucgcgggguccagugc

SEQ ID NO: 552 - RNA, 57 nt, Artificial Sequence
  derived and/or modified CDS sequence (opt11) from Homo sapiens__AAA52897__HsIGH@-HC(1-19)
auggacuggaccuggcgcguguucugucucuuggccgugaccccgggcgcgcacccg

SEQ ID NO: 553 - RNA, 57 nt, Artificial Sequence
  derived and/or modified CDS sequence (opt11) from Homo sapiens__AAA59018__HsIGL@-LC(1-19)
auggccugguccccacucuuccucacacucaucacccacugcgccggcuccugggcc

SEQ ID NO: 554 - RNA, 51 nt, Artificial Sequence
  derived and/or modified CDS sequence (opt11) from Gaussia princeps__AAG54095__GpLuc(1-17)
augggcgugaaagugcucuuugccuugaucuguaucgcggucgcggaagcg

SEQ ID NO: 555 - RNA, 63 nt, Artificial Sequence
  derived and/or modified CDS sequence (opt11) from Mus musculus__BAR42292__MmIgkappa(1-21)
auggaaaccgacacacuccuacucuggguccuccuccucuggguccccggcuccaccggcgac

SEQ ID NO: 556 - RNA, 78 nt, Artificial Sequence
  derived and/or modified CDS sequence (opt11) from Nepenthes rafflesiana__ABF74624__NrChit1(1-26)
augaaaacccacuacuccuccgccauccuccccauccucacccucuucgucuuccucuccaucaaccccucccacggc

SEQ ID NO: 557 - RNA, 63 nt, Artificial Sequence
  derived and/or modified CDS sequence (opt11) from Conus leopardus__AAS93426__ClLp1.1(1-21)
augggcaugcgcaugauguuuaucauguucaugcucguggucuuggccacgaccguggucucg

SEQ ID NO: 558 - RNA, 72 nt, Artificial Sequence; identical to SEQ ID NO: 398
  derived and/or modified CDS sequence (opt11) from Nepenthes gracilis__AB114914__NgNep1(1-24)

SEQ ID NO: 559 - RNA, 57 nt, Artificial Sequence
  derived and/or modified CDS sequence (opt11) from Homo sapiens__NP_001691__HsAzu1(1-19)
augacccgccucacaguccucgcccuacucgccggccuccucgccuccucccgcgcc

SEQ ID NO: 560 - RNA, 48 nt, Artificial Sequence; identical to SEQ ID NO: 400
  derived and/or modified CDS sequence (opt11) from Homo sapiens__AAA51948__HsCD33(1-16)

SEQ ID NO: 561 - RNA, 57 nt, Artificial Sequence
  derived and/or modified CDS sequence (opt11) from Vibrio cholerae__BAA06291__VcCtxB(1-19)
augaucaaacucaaauucggcgucuucuucaccguccuccucuccuccgccuacgcc

SEQ ID NO: 562 - RNA, 60 nt, Artificial Sequence
  derived and/or modified CDS sequence (opt11) from Homo sapiens__NP_001890__HsCST4(1-20)
auggcccgcccacucugcacccuacuccuccucauggccacccucgccggcgcccucgcc

SEQ ID NO: 563 - RNA, 72 nt, Artificial Sequence
  derived and/or modified CDS sequence (opt11) from Homo sapiens__AAA59172__HsIns-iso1(1-24)
auggcccucuggaugcgccuacucccccuccucgcccuacucgcccucuggggccccgaccccgccgccgcc

SEQ ID NO: 564 - RNA, 51 nt, Artificial Sequence
  derived and/or modified CDS sequence (opt11) from Homo sapiens__CAA68724__HsSPARC(1-17)
augcgcgcguggauauucuuucucuugugcuuggccgggcgcgcgcucgcg

SEQ ID NO: 565 - RNA, 51 nt, Artificial Sequence
  derived and/or modified CDS sequence (opt11) from Inluenza A__ACQ45338__H1N1-HA(1-17)
augaaagcgaucuuggucgugcucuuguacacguucgcgaccgcgaacgcg

SEQ ID NO: 566 - RNA, 75 nt, Artificial Sequence
  derived and/or modified CDS sequence (opt11) from Homo sapiens__CAA23783__HsMHCII(1-25)
auggcgaucucgggcgugcccgugcucggguucuuuaucauagccgugcucaugagcgcgcaagagagcugggcc

SEQ ID NO: 567 - RNA, 78 nt, Artificial Sequence
  derived and/or modified CDS sequence (opt11) from Nipah henipavirus__AAK50553__F(1-26)
auggucguaauacucgacaaacgcuguuacugcaaccuacuuauacucauccuuaugaucucagaaugcuccgucggc

SEQ ID NO: 568 - RNA, 78 nt, Artificial Sequence
  derived and/or modified CDS sequence (opt11) from Nipah henipavirus__AEZ01388__F(1-26)
auggccgucauccucaacaaacgcuacuacuccaaucugcucauacucauccucauuauuagcgaaugcucaguaggc

SEQ ID NO: 569 - RNA, 78 nt, Artificial Sequence
  derived and/or modified CDS sequence (opt11) from Nipah henipavirus__AAY43915__F(1-26)
auggccgucauacucaacaaacgauacuacucaaaccuccuuauccucaucuuaaugaucucugaaugcuccgucggc

SEQ ID NO: 570 - RNA, 78 nt, Artificial Sequence
  derived and/or modified CDS sequence (opt11) from Nipah henipavirus__CBM41033__F(1-26)
auggucgucauccucgacaaacgaugcuacuccaaccuccucauacuuauccucaugauuuccgaaugcucugucggc

SEQ ID NO: 571 - RNA, 78 nt, Artificial Sequence
  derived and/or modified CDS sequence (opt11) from Hendra henipavirus__NP_047111__F(1-26)
auggccacacaagaaguacgccucaaaugccuccuaugcggcauuauaguacucguccuaucccucgaaggccuagga

SEQ ID NO: 572 - RNA, 75 nt, Artificial Sequence
  derived and/or modified CDS sequence (opt11) from Hendra henipavirus__AEQ38114__F(1-25)
auggccacccaagaaguccgacugaaaugccuccucugcggaaucaucguccuaguccucucgcuggagggccuc

SEQ ID NO: 573 - protein, 520 aa, Artificial Sequence
  derived and/or modified protein sequence (wt) from Nipah henipavirus__AAK50553__F(27-546) (FdelSS)
ILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 574 - protein, 520 aa, Artificial Sequence
  derived and/or modified protein sequence (wt) from Nipah henipavirus__AEZ01388__F(27-546) (FdelSS)
ILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 575 - protein, 520 aa, Artificial Sequence
  derived and/or modified protein sequence (wt) from Nipah henipavirus__AAY43915__F(27-546) (FdelSS)
ILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYSSDLLFVFGPNLQDPVSNSMTIQAISQAFGGNYETLLRTLGYATEGFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 576 - protein, 520 aa, Artificial Sequence
  derived and/or modified protein sequence (wt) from Nipah henipavirus__CAF25496__F(27-546) (FdelSS)
ILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYAIEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 577 - protein, 520 aa, Artificial Sequence
  derived and/or modified protein sequence (wt) from Nipah henipavirus__AAM13405__F(27-546) (FdelSS)
ILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPTTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 578 - protein, 520 aa, Artificial Sequence
  derived and/or modified protein sequence (wt) from Nipah henipavirus__CBM41033__F(27-546) (FdelSS)
ILHYEKLSKIGLVKGVTRKYKIKSNPLTKDIVIKMIANVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQKSSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 579 - protein, 520 aa, Artificial Sequence; identical to SEQ ID NO: 574
  derived and/or modified protein sequence (wt) from Nipah henipavirus__AEZ01396__F(27-546) (FdelSS)

SEQ ID NO: 580 - protein, 520 aa, Artificial Sequence
  derived and/or modified protein sequence (wt) from Hendra henipavirus__NP_047111__F(27-546) (FdelSS)
ILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 581 - protein, 520 aa, Artificial Sequence
  derived and/or modified protein sequence (wt) from Hendra henipavirus__AEB21233__F(27-546) (FdelSS)
ILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 582 - protein, 520 aa, Artificial Sequence
  derived and/or modified protein sequence (wt) from Hendra henipavirus__AEQ38114__F(26-546) (FdelSS)
ILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFIIVEKKRGNYSRLDDRQVRPVSNGDLYYIGT

SEQ ID NO: 583 - protein, 520 aa, Artificial Sequence
  derived and/or modified protein sequence (wt) from Hendra henipavirus__AAB39505__F(27-546) (FdelSS)
ILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLLICSCFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSREQTLLMIDNTTCTTVVLGNIIISLPKYLGSIKLQVLRALLLGHQSIQTKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 584 - protein, 532 aa, Artificial Sequence
  derived and/or modified protein sequence (wt) from Nipah henipavirus__AAK50554__G(70-602) (solG)
QNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 585 - protein, 532 aa, Artificial Sequence
  derived and/or modified protein sequence (wt) from Nipah henipavirus__AEZ01389__G(70-602) (solG)
QNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPILNSTYWSGSLMMTRLAVKPKNNGESYNQHQFALRNIEKGKYDKVMPYGPSGIKQGDTLYFPAVGFLVRTEFKYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 586 - protein, 532 aa, Artificial Sequence
  derived and/or modified protein sequence (wt) from Nipah henipavirus__ACT32615__G(70-602) (solG)
QNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPVLNSTYWSGSLMMTRLAVKPKNNGESYNQHQFALRNIEKGKYDKVMPYGPSGIKQGDTLYFPAVGFLVRTEFKYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 587 - protein, 532 aa, Artificial Sequence
  derived and/or modified protein sequence (wt) from Nipah henipavirus__CAF25497__G(70-602) (solG)
QNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWAPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 588 - protein, 532 aa, Artificial Sequence
  derived and/or modified protein sequence (wt) from Nipah henipavirus__CBM41034__G(70-602) (solG)
QNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPDNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKIVFIEISDQRLSIGSPSKVYDSLGQPVFYQASFSWDTMIKFGDVQTVNPLVVNWRDNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 589 - protein, 532 aa, Artificial Sequence
  derived and/or modified protein sequence (wt) from Nipah henipavirus__AAX51853__G(70-602) (solG)
QNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQKIIGVGEVLDRGDEVPSLFMTNVWTPPNPNTVYHCSAVYNNEFYYVLCAVSTVGDPILNSTYWSGSLMMTRLAVKPKSNDGGYNQHQLALRSIEKGRYDKVMPYGPSGIKQGDTLYFPAVGFLVRTEFKYNDSNCPITKCQYSKPENCRLSMGIRPNSHYVLRSGLLKYNLSDGENPKIVFIEISDQRLSIGSPSKIYDSLGQPVFYQASFSWDTMIKFGDVQTVNPLVVSWRDNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 590 - protein, 532 aa, Artificial Sequence
  derived and/or modified protein sequence (wt) from Nipah henipavirus__AEZ01397__G(70-602) (solG)
QNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPILNSTYWSGSLMMTRLAVKPKNNGESYNQHQFALRNIEKGKYDKVMPYGPSGIKQGDTLYFPAVGFLVRTEFTYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 591 - protein, 534 aa, Artificial Sequence
  derived and/or modified protein sequence (wt) from Hendra henipavirus__NP_047112__G(70-604) (solG)
QNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 592 - protein, 534 aa, Artificial Sequence
  derived and/or modified protein sequence (wt) from Hendra henipavirus__AEB21225__G(70-604) (solG)
QNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDITLQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 593 - protein, 534 aa, Artificial Sequence
  derived and/or modified protein sequence (wt) from Hendra henipavirus__AEB21216__G(70-604) (solG)
QNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAINKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 594 - protein, 534 aa, Artificial Sequence
  derived and/or modified protein sequence (wt) from Hendra henipavirus__AEB21206__G(70-604) (solG)
QNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGNYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDIDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 595 - protein, 534 aa, Artificial Sequence
  derived and/or modified protein sequence (wt) from Hendra henipavirus__AEQ38052__G(70-604) (solG)
QNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYITITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 596 - protein, 534 aa, Artificial Sequence
  derived and/or modified protein sequence (wt) from Hendra henipavirus__AEQ38115__G(70-604) (solG)
QNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDNGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 597 - protein, 534 aa, Artificial Sequence
  derived and/or modified protein sequence (wt) from Hendra henipavirus__AEQ38108__G(70-604) (solG)
QNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYITITKVERGKYDKVMPYGPSGIKQGNTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 598 - protein, 534 aa, Artificial Sequence
  derived and/or modified protein sequence (wt) from Hendra henipavirus__AAV80426__G(70-604) (solG)
QNYTRTTDNQALIKESLQSVQQQIKALTDKIGTEIGPKVSLIDTSSTITIPANIGLLGSKISQCTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGSYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 599 - RNA, 1563 nt, Artificial Sequence
  derived and/or modified CDS sequence (wt) from Nipah henipavirus__AAK50553__F(27-546) (FdelSS)
auucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuuaguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuaugaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 600 - RNA, 1563 nt, Artificial Sequence
  derived and/or modified CDS sequence (wt) from Nipah henipavirus__AEZ01388__F(27-546) (FdelSS)
auuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacuaacugcuuugcaggauuacauuaauacuaacuugguaccgacaauugacaagauaagcugcaaacagacggaacucucauuagaucuagcacuaucaaaguaccucucugauuugcuuuuuguauuuggucccaaccuucaagacccaguuucuaauucaaugacuauacaggcuauaucucaggcauucgguggaaauuaugaaacacugcuaagaacguuggguuacgcuacagaagacuuugaugaucuucuagaaagugacagcauaacgggucaaauuaucuacguugauuuaaguggcuacuacauaauugucaggguuuauuuuccuauccugacugaaauccaacaggccuauauccaagaauuguugcccgugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcugaugauugauaacaccaccuguccuacagcuguacucgguaaugugaucaucagcuugggaaaauaucuugggucaguaaauuauaacucugaaggcauugcuauugguccuccugucuuuacugauaaaguugacauaucaagucaaauaucuagcaugaaucaguccuuacagcaaucuaaggacuauaucaaagaagcucaacgacuccuugauacuguuaacccgucauuaauaagcauguuaucuaugaucauacuguauguacuaucaauugcaucauuguguauaggguugauuacauuuaucaguuuuaucauuguugagaaaaaaagaaauaccuauagcagauuagaggacaggagggucagaccuacaagcaguggggaucucuauuacauugggacguag

SEQ ID NO: 601 - RNA, 1563 nt, Artificial Sequence
  derived and/or modified CDS sequence (wt) from Nipah henipavirus__AAY43915__F(27-546) (FdelSS)
auuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguacuccucugauuugcuuuuuguauuuggucccaaccuucaagacccaguuucuaauucaaugacuauacaggcuauaucucaggcauucgguggaaauuaugaaacacugcuaagaacguuggguuacgcuacagaaggcuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcuaaugauugauaacaccaccuguccuacagcuguacucgguaaugugaucaucagcuuggggaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 602 - RNA, 1563 nt, Artificial Sequence
  derived and/or modified CDS sequence (wt) from Nipah henipavirus__CAF25496__F(27-546) (FdelSS)
auucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcuuuacaggauuacauuaauacuaauuuaguaccgacaauugacaaaauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuauagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauuaguaaggaauacauuaauaucaaauauagagauuggauuuugccuaauuacaaagaggagcgugaucugcaaccaagauuaugccacaccuaugaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 603 - RNA, 1563 nt, Artificial Sequence
  derived and/or modified CDS sequence (wt) from Nipah henipavirus__AAM13405__F(27-546) (FdelSS)
auucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuuaguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuacgaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 604 - RNA, 1563 nt, Artificial Sequence
  derived and/or modified CDS sequence (wt) from Nipah henipavirus__CBM41033__F(27-546) (FdelSS)
auucuacauuaugagaaauugaguaaaauuggacuugucaaaggaguaacaagaaaauacaagauuaaaagcaauccucucacaaaagacauuguuauaaaaaugauugcgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugccauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuugguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuaugaccaacaacaugagagaauguuugacgggaucgacugagaaguguccucgagagcugguuguuucaucacauguucccagauuugcacuaucuaacggaguucuguuugccaauugcauaaguguuacaugccagugucaaacaacaggcagggcaaucucacagucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagaaauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuggaggauaggagagucagaccuacaagcaguggggaucucuacuacauugggacauag

SEQ ID NO: 605 - RNA, 1563 nt, Artificial Sequence
  derived and/or modified CDS sequence (wt) from Nipah henipavirus__AEZ01396__F(27-546) (FdelSS)
auuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaacuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguaccucucugauuugcuuuuuguauuuggucccaaccuucaagacccaguuucuaauucaaugacuauacaggcuauaucucaggcauucgguggaaauuaugaaacacugcuaagaacguuggguuacgcuacagaagacuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcuggugguuucaucacacguucccagauuugcacuaucuaacgggguuuuguuugcuaauugcauaagcgucacaugccagugucaaacaacagguagggcaaucucacagucaggagaacaaacucugcugaugauugauaacaccaccuguccuacagccguacucgguaaugugaucaucagcuugggaaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 606 - RNA, 1563 nt, Artificial Sequence
  derived and/or modified CDS sequence (wt) from Hendra henipavirus__NP_047111__F(27-546) (FdelSS)
auacuacauuaugagaaacuuaguaagauagggcugguuaaagguauuacaagaaaguacaagauuaagaguaacccuuugaccaaggauauugugaucaaaaugaucccuaaugucucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcagguguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagagcucgcauuagacuuggcguugucuaaguaucugucugaucugcucuuuguuuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauagcaggccagauagucuauguagaucucaguagcuauuacauaauaguaaggguguauuuucccauacuaacagagauccaacaggcuuaugugcaggaguugcuuccagugaguuuuaauaacgauaauucagaauggaucagcauugucccgaauuucgugcugauuaggaacacgcugauuucaaauauagaagucaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcagcacugugcauuggucugaucacuuucauaagcuuuguaauaguugagaaaaagagagggaauuacagcaggcuagaugauaggcaagugcgaccggucaguaauggugaucuguauuauauuggaacauaa

SEQ ID NO: 607 - RNA, 1563 nt, Artificial Sequence
  derived and/or modified CDS sequence (wt) from Hendra henipavirus__AEB21233__F(27-546) (FdelSS)
auacuacauuaugagaaacuuaguaagauagggcugguuaaagguauuacaagaaaguacaagauuaagaguaacccuuugaccaaggauauuguaaucaaaaugaucccuaauguuucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcaggcguggugauggcagggauugcaaucgggauagcuacugcugcacaaaucacagcagguguugcguuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagaacucgcauuagacuuggcguugucuaaguaucugucugaucugcucuuuguuuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuuccuauacuaacagagauccaacaggcuuaugugcaggaguugcuuccagugaguuuuaauaacgauaauucagaauggaucagcauugucccgaauuucgugcugauuaggaacacgcugauuucaaauauagaaguuaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauucgcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcggcacugugcauuggucugaucacuuucauaagcuuuguaauaguugagaaaaagagagggaauuacagcaggcuagaugauaggcaggugcgaccggucaguaauggugaucuguauuauauuggaacauaa

SEQ ID NO: 608 - RNA, 1566 nt, Artificial Sequence
  derived and/or modified CDS sequence (wt) from Hendra henipavirus__AEQ38114__F(26-546) (FdelSS)
gggauacuacauuaugagaaacuuaguaagauagggcugguuaaagguauuacaagaaaguacaagauuaagaguaacccuuugaccaaggauauuguaaucaaaaugaucccuaauguuucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcaggcguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagaacucgcauuagacuuggcguugucuaaguaucugucugaucugcucuuuguuuucggacccaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuuccuauacuaacagagauccaacaggcuuaugugcaggaguugcuuccagugaguuuuaauaacgauaauucagaauggaucagcauugucccgaauuucgugcugauuaggaacacgcugauuucaaauauagaaguuaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcggcacugugcauuggucugaucacuuucauaagcuuuauaauaguugagaaaaagagagggaauuacagcaggcuagaugauaggcaggugcgaccggucaguaauggugaucuguauuauauuggaacauaa

SEQ ID NO: 609 - RNA, 1563 nt, Artificial Sequence
  derived and/or modified CDS sequence (wt) from Hendra henipavirus__AAB39505__F(27-546) (FdelSS)
auacuacauuaugagaaacuuaguaagauagggcugguuaaagguauuacaagaaaguacaagauuaagaguaacccuuugaccaaggauauugugaucaaaaugaucccuaaugucucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcagguguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagagcucgcauuagacuuggcguugucuaaguaucugcugaucugcucuuguuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuucccauacuaacagagauccaacaggcuuaugugcaggaguugcuuccagugaguuuuaauaacgauaauucagaauggaucagcauugucccgaauuucgugcugauuaggaacacgcugauuucaaauauagaagucaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaauccagggaacagacacuacugaugauugacaauacuaccugcacaacaguuguucuaggaaacauaaucauaagccuuccaaaauauuugggaucaauaaaguuacaaguucugagagcauugcuguugggccaccagucuauacagacaaagguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcagcacugugcauuggucugaucacuuucauaagcuuuguaauaguugagaaaaagagagggaauuacagcaggcuagaugauaggcaagugcgaccggucaguaauggugaucuguauuauauuggaacauaa

SEQ ID NO: 610 - RNA, 1599 nt, Artificial Sequence
  derived and/or modified CDS sequence (wt) from Nipah henipavirus__AAK50554__G(70-602) (solG)
caaaauuacacaagaucaacagacaaucaggccgugaucaaagaugcguugcaggguauccaacagcagaucaaagggcuugcugacaaaaucggcacagagauagggcccaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacucccuuuuagagaguauaggccacagacagaaggggugagcaaucuaguaggauuaccuaauaauauuugccugcaaaagacaucuaaucagauauugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucuggaccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaguuguauucauugaaauaucugaucaaagauuaucuauuggaucuccuagcaaaaucuaugauucuuugggucaaccuguuuucuaccaagcgucauuuucaugggauacuaugauuaaauuuggagauguucuaacagucaacccucugguugucaauuggcguaauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuuuacuguauucaaagauaaugaaauacuuuauagggcacaacuggcuucugaggacaccaaugcacaaaaaacaauaacuaauuguuuucucuugaagaauaagauuuggugcauaucauugguugagauauaugacacaggagacaaugucauaagacccaaacuauucgcgguuaagauaccagagcaauguacauaa

SEQ ID NO: 611 - RNA, 1599 nt, Artificial Sequence
  derived and/or modified CDS sequence (wt) from Nipah henipavirus__AEZ01389__G(70-602) (solG)
cagaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuaucccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguguacaacaaugaauucuauuaugugcuuugugcagugucaguuguuggagacccuauucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguagguuuuuuggucaggacagaguucaaauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucaaccuguuuucuaccaagcgucuuuuucaugggacacuaugauuaaauuuggagauguccaaacaguuaacccuuuaguuguaaauuggcgugacaacacgguaaucucaagaccuggacaaucacaaugcccuagauucaacaagugcccagagguuugcugggaagggguuuauaaugaugccuuccugauugauagaaucaauuggauaagugcggguguauuccuugacagcaaccagaccgcagagaauccuguuuuuacuguauucaaagauaaugaaguacuuuacagagcacaacuagccuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 612 - RNA, 1599 nt, Artificial Sequence
  derived and/or modified CDS sequence (wt) from Nipah henipavirus__ACT32615__G(70-602) (solG)
caaaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuaucccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguauacaacaaugaauucuauuaugugcuuugugcagugucaguuguuggagacccuguucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguagguuuuuuggucaggacagaguucaaauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucagccuguuuucuaccaagcgucuuuuucaugggacacuaugauuaaauuuggagauguccaaacaguuaacccuuuaguuguaaauuggcgugacaacacgguaaucucaagaccugggcaaucacaaugcccuagauucaacaagugcccagagguuugcugggaagggguuuauaaugaugccuuccugauugauagaaucaauuggauaagugcggguguauuccuugacagcaaccagaccgcagagaauccuguuuuuacuguauucaaagauaaugaaguacuuuacagagcacaacuagcuuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 613 - RNA, 1599 nt, Artificial Sequence
  derived and/or modified CDS sequence (wt) from Nipah henipavirus__CAF25497__G(70-602) (solG)
caaaauuacacaagaucaacagacaaucaggccgugaucaaagaugcguugcaagguauccaacagcagaucaaagggcuugcugacaaaaucggcacagagauagggcccaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacucccuuuuagagaguauaggccacagacagaaggggugagcaaucugguaggauuaccuaauaauauuugccugcaaaagacaucuaaucagauauugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucugggccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaguuguauucauugaaauaucugaucaaagauuaucuauuggaucuccuagcaaaaucuaugauucuuugggucaaccuguuuucuaccaagcgucauuuucaugggauacuaugauuaaauuuggagauguucuaacagucaacccucugguugucaauuggcguaauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuuuacuguauucaaagauaaugaaauacuuuauagggcacaacuggcuucugaggacaccaaugcacaaaaaacaauaacuaauuguuuucucuugaagaauaagauuuggugcauaucauugguugagauauaugacacaggagacaaugucauaagacccaaacuauucgcgguuaagauaccagagcaauguacauaa

SEQ ID NO: 614 - RNA, 1599 nt, Artificial Sequence
  derived and/or modified CDS sequence (wt) from Nipah henipavirus__CBM41034__G(70-602) (solG)
caaaauuacacaagaucaacagacaaucaggccgugaucaaagaugcguugcaggguauccaacagcagaucaaagggcuugcugacaaaaucggcacagagauagggccuaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacuccccuuuagagaguauaggccgcagacagaaggggugagcaaucugguaggauuaccugauaauauuugccugcaaaagacaucuaaucagauacugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucuggaccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaauuguauucauugaaauaucugaucaaagauuaucuauuggaucuccuagcaaagucuaugauucuuugggucaaccuguuuucuaccaagcgucauuuucaugggauacuaugauuaaauuuggagauguucaaacagucaacccucugguugucaauuggcgugauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuucacuguauucaaagauaaugaaauacuuuauagggcacaacuggcuucugaggacaccaaugcacaaaaaacaauaacuaauugcuuucucuugaagaauaagauuuggugcauaucauugguugagauauaugacacaggagacaaugucauaagacccaaacuauucgcgguuaagauaccagagcaauguacauaa

SEQ ID NO: 615 - RNA, 1599 nt, Artificial Sequence
  derived and/or modified CDS sequence (wt) from Nipah henipavirus__AAX51853__G(70-602) (solG)
caaaauuauacaagaucaacagacaaucaggccgugaucaaagaugcguugcaggguauccaacagcagaucaaagggcuugcugacaaaaucggcacagagauagggcccaaaguaucacugauugacacauccaguacuauuacuaucccagcuaacauugggcuguuagguucaaagaucagccagucgacugcaaguauaaaugagaaugugaaugaaaaauguaaauucacauugccucccuugaaaauccacgaauguaacauuucuugucccaacccacucccuuuuagagaguauaggccgcagacagaaggagugagcaaucugguaggauuaccuaauaauauuugccugcaaaagacaucuaaucagauacugaagccaaagcugauuucauacacuuuaccuguagucggucaaagugguaccuguaucacagacccauugcuggcuauggacgagggcuauuuugcauauagccaccuggaaagaaucggaucauguucaagaggggucuccaaacaaaaaauaauaggaguuggagagguacuagacagaggugaugaaguuccuucuuuauuuaugaccaaugucuggaccccaccaaauccaaacacuguuuaccacuguagugcuguauacaacaaugaauucuauuaugugcuuugugcagugucaacuguuggagacccuauucugaauagcaccuacugguccggaucucuaaugaugacccgucuagcuguaaaacccaagaguaaugauggggguuacaaucaacaucaacuugcccuacgaaguaucgagaaagggagguaugauaaagucaugccguauggaccuucaggcaucaaacagggugacacccuguauuuuccugcuguaggauuuuuggucaggacagaguucaaauacaaugauucaaauugucccaucacgaagugucaauacaguaaaccugaaaauugcaggcuaucuauggggauuagaccaaacagccauuauguccuucgaucuggacuauuaaaauacaaucuaucagauggggagaacccuaaaauuguauucauugaaauaucugaucaaagauuaucuauuggaucuccuagcaaaaucuaugauucuuugggucaaccuguuuucuaccaagcgucauuuucaugggauacuaugauuaaauuuggagauguucaaacagucaacccuuugguuguaaguuggcgugauaacacgguaauaucaagaccugggcaaucgcaaugcccuagauucaauacauguccagagaucugcugggaaggaguuuauaaugaugcauuccuaauugacagaaucaauuggauaagcgcagguguauuccuugacagcaaucagaccgcagaaaauccuguuuuuacuguauucaaagauaaugaaauacuuuauagagcacaacuggcuucugaggacaccaaugcacaaaaaacaauaacuaauugcuuucucuugaagaauaagauuuggugcauaucauugguugagauauaugacacaggagacaaugucauaagacccaaacuauucgcaguuaagauaccagagcaauguacauaa

SEQ ID NO: 616 - RNA, 1599 nt, Artificial Sequence
  derived and/or modified CDS sequence (wt) from Nipah henipavirus__AEZ01397__G(70-602) (solG)
caaaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuauuccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguguacaacaaugaauucuauuaugugcuuugugcagugucaguuguuggagacccuauucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguaggauuuuuggucaggacagaguucacauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucaaccuguuuucuaccaagcaucuuuuucaugggacacuaugauuaaauuuggagauguccaaacaguuaacccuuuaguuguaaauuggcgugacaacacgguaaucucaagaccugggcaaucacaaugcccuagauucaacaagugcccagagguuugcugggaagggguuuauaaugaugcuuuccugauugauagaaucaauuggauaagcgcggguguauuccuugacagcaaccagaccgcagagaauccuguuuuuacuguauucaaagauaaugaaguacuuuacagagcacaacuagcuuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 617 - RNA, 1605 nt, Artificial Sequence
  derived and/or modified CDS sequence (wt) from Hendra henipavirus__NP_047112__G(70-604) (solG)
caaaauuacaccagaacgacugauaaucaggcacuaaucaaagagucacuccagaguguacagcaacaaaucaaagcuuuaacagacaaaaucgggacagagauaggccccaaagucucacuaauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaacuaaaguugaaagagggaaguacgauaaggugaugccuuacgguccaucagguaucaagcaaggggauacauuguacuuuccggccgucgguuuuuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucuaucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuauuugcagucaagauaccugcccaauguucagagaguuga

SEQ ID NO: 618 - RNA, 1605 nt, Artificial Sequence
  derived and/or modified CDS sequence (wt) from Hendra henipavirus__AEB21225__G(70-604) (solG)
caaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacgucaacaaucuuaaagcccaggcugauauccuauacucuaccaauuaauaccagagaagggguuugcaucacugacccacuuuuggcuguugauaauggcuucuucgccuauagccaucuugaaaagaucggaucaugcacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaauggguguuaacuccaaaagucauuauauuuugagaucaggacuauugaaguauaaucugucucuuggaggagacaucacacuccaauuuaucgagauugcugacaauagauugaccaucgguucuccuaguaagauauacaauucucuaggucaaccugucuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 619 - RNA, 1605 nt, Artificial Sequence
  derived and/or modified CDS sequence (wt) from Hendra henipavirus__AEB21216__G(70-604) (solG)
caaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaauccuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucacugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaaauaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucgaugggugucaacuccaaaagucauuauauuuugagaucaggacuauugaaguauaaucugucucuaggaggagacaucauacuucaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 620 - RNA, 1605 nt, Artificial Sequence
  derived and/or modified CDS sequence (wt) from Hendra henipavirus__AEB21206__G(70-604) (solG)
caaaauuacaccagaacgacugauaaucaggcacuaaucaaagagucgcuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggaaacuacaaucagaaauacaucgcuauaacuaaaguugaaagagggaaguacgauaaggugaugccuuacgguccaucagguaucaagcaaggggauacauuguacuuuccggccgucgguuuuuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucuaucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauauugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuauuugcagucaagauaccugcccaauguucagagaguuga

SEQ ID NO: 621 - RNA, 1605 nt, Artificial Sequence
  derived and/or modified CDS sequence (wt) from Hendra henipavirus__AEQ38052__G(70-604) (solG)
caaaacuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucacuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugcuguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 622 - RNA, 1605 nt, Artificial Sequence
  derived and/or modified CDS sequence (wt) from Hendra henipavirus__AEQ38115__G(70-604) (solG)
caaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuaggggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcaguaucccaugugggagauccuauccuuaacaguacuuccuggacagagucacugucucugauucgucuugcuguaagaccaaaaagugauaauggagacuacaaucagaaauacaucgcuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucucuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 623 - RNA, 1605 nt, Artificial Sequence
  derived and/or modified CDS sequence (wt) from Hendra henipavirus__AEQ38108__G(70-604) (solG)
caaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucacuauaacuaaaguugaaagagggaaguacgauaaggugaugccuuacgguccaucagguaucaagcaagggaauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugcuguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 624 - RNA, 1605 nt, Artificial Sequence
  derived and/or modified CDS sequence (wt) from Hendra henipavirus__AAV80426__G(70-604) (solG)
cagaacuacacccggaccaccgauaaucaggcccugaucaaggagagccugcagucugugcagcagcagaucaaggcccugaccgacaagaucggcacagagaucggcccuaaagugagccugaucgacaccagcagcaccaucaccauccccgccaauaucggacugcugggcuccaagaucagccagugcaccagcuccaucaacgagaacgugaacgacaagugcaaguucacccugcccccccugaagauccacgagugcaacaucagcugccccaacccccugcccuucagagaguacaggcccaucagccagggagugagcgaucuggugggccugcccaaucagaucugccugcagaaaaccaccuccaccauccugaagccccggcugaucagcuacacccugcccaucaacacaagagagggcgugugcaucaccgauccucugcuggccguggacaacggcuucuucgccuacagccaccuggagaagaucggcagcugcacaagaggcaucgccaagcagagaaucaucggcgugggcgaagugcuggacagaggcgacaaagugcccagcauguucaugaccaacguguggacccccccuaauccuagcaccauccaccacugcagcagcaccuaccacgaggacuucuacuacacccugugcgccgugucucaugugggcgaccccauccugaauagcaccagcuggaccgagagccugucccugauuagacuggccgugaggcccaagagcgauagcggcgacuacaaccagaaguacaucgccaucaccaaaguggagcggggcaaguacgacaaagugaugcccuauggccccagcggaaucaagcagggcgacacccuguacuuucccgccgugggcuuucugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugacaaucggcagccccagcaagaucuacaacagccugggccagcccguguuuuaccaggccagcuacagcugggacaccaugaucaagcugggcgauguggacacaguggacccccugagagugcaguggcggaacaacagcgugaucagcagaccuggccagagccagugccccagauucaacgugugccccgaaguguguugggagggcagcuacaacgacgccuuccugaucgaccggcugaauugggugagcgccggaguguaccugaacagcaaccagaccgccgagaacccuguguucgccguguucaaggacaacgagauccuguaccaagugccccuggccgaggaugauaccaacgcccagaaaaccaucaccgacugcuuccugcuggagaacgugaucuggugcaucagccugguggagaucuacgacaccggcgacagcgugauuaggcccaagcuguucgcugugaagaucccugcccagugcagcgagagcuga

SEQ ID NO: 625 - RNA, 1563 nt, Artificial Sequence
  derived and/or modified CDS sequence (opt1) from Nipah henipavirus__AAK50553__F(27-546) (FdelSS)
auccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccuga

SEQ ID NO: 626 - RNA, 1563 nt, Artificial Sequence
  derived and/or modified CDS sequence (opt1) from Nipah henipavirus__AEZ01388__F(27-546) (FdelSS)
auccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccuga

SEQ ID NO: 627 - RNA, 1563 nt, Artificial Sequence
  derived and/or modified CDS sequence (opt1) from Nipah henipavirus__AAY43915__F(27-546) (FdelSS)
auccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccuga

SEQ ID NO: 628 - RNA, 1563 nt, Artificial Sequence
  derived and/or modified CDS sequence (opt1) from Nipah henipavirus__CAF25496__F(27-546) (FdelSS)
auccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacguga

SEQ ID NO: 629 - RNA, 1563 nt, Artificial Sequence
  derived and/or modified CDS sequence (opt1) from Nipah henipavirus__AAM13405__F(27-546) (FdelSS)
auccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccuga

SEQ ID NO: 630 - RNA, 1563 nt, Artificial Sequence
  derived and/or modified CDS sequence (opt1) from Nipah henipavirus__CBM41033__F(27-546) (FdelSS)
auccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccuga

SEQ ID NO: 631 - RNA, 1563 nt, Artificial Sequence; identical to SEQ ID NO: 626
  derived and/or modified CDS sequence (opt1) from Nipah henipavirus__AEZ01396__F(27-546) (FdelSS)

SEQ ID NO: 632 - RNA, 1563 nt, Artificial Sequence
  derived and/or modified CDS sequence (opt1) from Hendra henipavirus__NP_047111__F(27-546) (FdelSS)
auccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacguga

SEQ ID NO: 633 - RNA, 1563 nt, Artificial Sequence
  derived and/or modified CDS sequence (opt1) from Hendra henipavirus__AEB21233__F(27-546) (FdelSS)
auccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccuga

SEQ ID NO: 634 - RNA, 1566 nt, Artificial Sequence
  derived and/or modified CDS sequence (opt1) from Hendra henipavirus__AEQ38114__F(26-546) (FdelSS)
ggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccuga

SEQ ID NO: 635 - RNA, 1563 nt, Artificial Sequence
  derived and/or modified CDS sequence (opt1) from Hendra henipavirus__AAB39505__F(27-546) (FdelSS)
auccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccuga

SEQ ID NO: 636 - RNA, 1599 nt, Artificial Sequence
  derived and/or modified CDS sequence (opt1) from Nipah henipavirus__AAK50554__G(70-602) (solG)
cagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccuga

SEQ ID NO: 637 - RNA, 1599 nt, Artificial Sequence
  derived and/or modified CDS sequence (opt1) from Nipah henipavirus__AEZ01389__G(70-602) (solG)
cagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccuga

SEQ ID NO: 638 - RNA, 1599 nt, Artificial Sequence
  derived and/or modified CDS sequence (opt1) from Nipah henipavirus__ACT32615__G(70-602) (solG)
cagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccuga

SEQ ID NO: 639 - RNA, 1599 nt, Artificial Sequence
  derived and/or modified CDS sequence (opt1) from Nipah henipavirus__CAF25497__G(70-602) (solG)
cagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccuga

SEQ ID NO: 640 - RNA, 1599 nt, Artificial Sequence
  derived and/or modified CDS sequence (opt1) from Nipah henipavirus__CBM41034__G(70-602) (solG)
cagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccuga

SEQ ID NO: 641 - RNA, 1599 nt, Artificial Sequence
  derived and/or modified CDS sequence (opt1) from Nipah henipavirus__AAX51853__G(70-602) (solG)
cagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccuga

SEQ ID NO: 642 - RNA, 1599 nt, Artificial Sequence
  derived and/or modified CDS sequence (opt1) from Nipah henipavirus__AEZ01397__G(70-602) (solG)
cagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacguga

SEQ ID NO: 643 - RNA, 1605 nt, Artificial Sequence
  derived and/or modified CDS sequence (opt1) from Hendra henipavirus__NP_047112__G(70-604) (solG)
cagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcuga

SEQ ID NO: 644 - RNA, 1605 nt, Artificial Sequence
  derived and/or modified CDS sequence (opt1) from Hendra henipavirus__AEB21225__G(70-604) (solG)
cagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcuga

SEQ ID NO: 645 - RNA, 1605 nt, Artificial Sequence
  derived and/or modified CDS sequence (opt1) from Hendra henipavirus__AEB21216__G(70-604) (solG)
cagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcuga

SEQ ID NO: 646 - RNA, 1605 nt, Artificial Sequence
  derived and/or modified CDS sequence (opt1) from Hendra henipavirus__AEB21206__G(70-604) (solG)
cagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcuga

SEQ ID NO: 647 - RNA, 1605 nt, Artificial Sequence
  derived and/or modified CDS sequence (opt1) from Hendra henipavirus__AEQ38052__G(70-604) (solG)
cagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcuga

SEQ ID NO: 648 - RNA, 1605 nt, Artificial Sequence
  derived and/or modified CDS sequence (opt1) from Hendra henipavirus__AEQ38115__G(70-604) (solG)
cagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccuga

SEQ ID NO: 649 - RNA, 1605 nt, Artificial Sequence
  derived and/or modified CDS sequence (opt1) from Hendra henipavirus__AEQ38108__G(70-604) (solG)
cagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcuga

SEQ ID NO: 650 - RNA, 1605 nt, Artificial Sequence
  derived and/or modified CDS sequence (opt1) from Hendra henipavirus__AAV80426__G(70-604) (solG)
cagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcuga

SEQ ID NO: 651 - RNA, 1563 nt, Artificial Sequence
  derived and/or modified CDS sequence (opt2) from Nipah henipavirus__AAK50553__F(27-546) (FdelSS)
auccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 652 - RNA, 1563 nt, Artificial Sequence
  derived and/or modified CDS sequence (opt2) from Nipah henipavirus__AEZ01388__F(27-546) (FdelSS)
auccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 653 - RNA, 1563 nt, Artificial Sequence
  derived and/or modified CDS sequence (opt2) from Nipah henipavirus__AAY43915__F(27-546) (FdelSS)
auccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguacuccuccgaccuccucuucgucuucggccccaaccuccaggaccccgucuccaacuccaugaccauccaggccaucucccaggccuucggcggcaacuacgagacccuccuccgcacccucggcuacgccaccgagggcuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 654 - RNA, 1563 nt, Artificial Sequence
  derived and/or modified CDS sequence (opt2) from Nipah henipavirus__CAF25496__F(27-546) (FdelSS)
auccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaucgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 655 - RNA, 1563 nt, Artificial Sequence
  derived and/or modified CDS sequence (opt2) from Nipah henipavirus__AAM13405__F(27-546) (FdelSS)
auccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaccaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 656 - RNA, 1563 nt, Artificial Sequence
  derived and/or modified CDS sequence (opt2) from Nipah henipavirus__CBM41033__F(27-546) (FdelSS)
auccuccacuacgagaagcucuccaagaucggccucgucaagggcgucacccgcaaguacaagaucaaguccaacccccucaccaaggacaucgucaucaagaugaucgccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaaguccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 657 - RNA, 1563 nt, Artificial Sequence; identical to SEQ ID NO: 652
  derived and/or modified CDS sequence (opt2) from Nipah henipavirus__AEZ01396__F(27-546) (FdelSS)

SEQ ID NO: 658 - RNA, 1563 nt, Artificial Sequence
  derived and/or modified CDS sequence (opt2) from Hendra henipavirus__NP_047111__F(27-546) (FdelSS)
auccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucgccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 659 - RNA, 1563 nt, Artificial Sequence
  derived and/or modified CDS sequence (opt2) from Hendra henipavirus__AEB21233__F(27-546) (FdelSS)
auccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 660 - RNA, 1566 nt, Artificial Sequence
  derived and/or modified CDS sequence (opt2) from Hendra henipavirus__AEQ38114__F(26-546) (FdelSS)
ggcauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucaucaucgucgagaagaagcgcggcaacuacucccgccucgacgaccgccagguccgccccgucuccaacggcgaccucuacuacaucggcaccuga

SEQ ID NO: 661 - RNA, 1563 nt, Artificial Sequence
  derived and/or modified CDS sequence (opt2) from Hendra henipavirus__AAB39505__F(27-546) (FdelSS)
auccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccuccucaucugcuccugcuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccagucccgcgagcagacccuccucaugaucgacaacaccaccugcaccaccgucguccucggcaacaucaucaucucccuccccaaguaccucggcuccaucaagcuccagguccuccgcgcccuccuccucggccaccaguccauccagaccaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 662 - RNA, 1599 nt, Artificial Sequence
  derived and/or modified CDS sequence (opt2) from Nipah henipavirus__AAK50554__G(70-602) (solG)
cagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaaggucgucuucaucgagaucuccgaccagcgccucuccaucggcucccccuccaagaucuacgacucccucggccagcccgucuucuaccaggccuccuucuccugggacaccaugaucaaguucggcgacguccucaccgucaacccccucgucgucaacuggcgcaacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 663 - RNA, 1599 nt, Artificial Sequence
  derived and/or modified CDS sequence (opt2) from Nipah henipavirus__AEZ01389__G(70-602) (solG)
cagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccauccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaaguacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 664 - RNA, 1599 nt, Artificial Sequence
  derived and/or modified CDS sequence (opt2) from Nipah henipavirus__ACT32615__G(70-602) (solG)
cagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccguccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaaguacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 665 - RNA, 1599 nt, Artificial Sequence
  derived and/or modified CDS sequence (opt2) from Nipah henipavirus__CAF25497__G(70-602) (solG)
cagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucugggccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaaggucgucuucaucgagaucuccgaccagcgccucuccaucggcucccccuccaagaucuacgacucccucggccagcccgucuucuaccaggccuccuucuccugggacaccaugaucaaguucggcgacguccucaccgucaacccccucgucgucaacuggcgcaacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 666 - RNA, 1599 nt, Artificial Sequence
  derived and/or modified CDS sequence (opt2) from Nipah henipavirus__CBM41034__G(70-602) (solG)
cagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccgacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaagaucgucuucaucgagaucuccgaccagcgccucuccaucggcucccccuccaaggucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 667 - RNA, 1599 nt, Artificial Sequence
  derived and/or modified CDS sequence (opt2) from Nipah henipavirus__AAX51853__G(70-602) (solG)
cagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagaagaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacgacggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacguccuccgcuccggccuccucaaguacaaccucuccgacggcgagaaccccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucuccuggcgcgacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 668 - RNA, 1599 nt, Artificial Sequence
  derived and/or modified CDS sequence (opt2) from Nipah henipavirus__AEZ01397__G(70-602) (solG)
cagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccauccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaccuacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 669 - RNA, 1605 nt, Artificial Sequence
  derived and/or modified CDS sequence (opt2) from Hendra henipavirus__NP_047112__G(70-604) (solG)
cagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 670 - RNA, 1605 nt, Artificial Sequence
  derived and/or modified CDS sequence (opt2) from Hendra henipavirus__AEB21225__G(70-604) (solG)
cagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucacccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 671 - RNA, 1605 nt, Artificial Sequence
  derived and/or modified CDS sequence (opt2) from Hendra henipavirus__AEB21216__G(70-604) (solG)
cagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaacaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 672 - RNA, 1605 nt, Artificial Sequence
  derived and/or modified CDS sequence (opt2) from Hendra henipavirus__AEB21206__G(70-604) (solG)
cagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcaacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacaucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 673 - RNA, 1605 nt, Artificial Sequence
  derived and/or modified CDS sequence (opt2) from Hendra henipavirus__AEQ38052__G(70-604) (solG)
cagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucaccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 674 - RNA, 1605 nt, Artificial Sequence
  derived and/or modified CDS sequence (opt2) from Hendra henipavirus__AEQ38115__G(70-604) (solG)
cagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacaacggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 675 - RNA, 1605 nt, Artificial Sequence
  derived and/or modified CDS sequence (opt2) from Hendra henipavirus__AEQ38108__G(70-604) (solG)
cagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucaccaucaccaaggucgagcgcggcaaguacgacaaggucaugcccuacggccccuccggcaucaagcagggcaacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 676 - RNA, 1605 nt, Artificial Sequence
  derived and/or modified CDS sequence (opt2) from Hendra henipavirus__AAV80426__G(70-604) (solG)
cagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccagugcaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcuccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 677 - RNA, 1563 nt, Artificial Sequence
  derived and/or modified CDS sequence (opt3) from Nipah henipavirus__AAK50553__F(27-546) (FdelSS)
auuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaccgaggacuuugaugaccugcucgagagugauagcaucacaggucagauaauuuacguggaccuuucuuccuauuacaucaucguacguguguauuucccaauucugaccgaaauccaacaggccuacauucaggaguugcuacccgucucauuuaacaaugacaacagcgaauggauaaguaucgugccuaauuucauucugguuagaaacacgcucaucucuaauaucgagauuggcuuuugucugauaacuaagagguccgugaucugcaaccaggauuaugcaacaccaaugaccaauaacaugcgggaaugucuuacugggagcacagagaaaugcccccgcgagcuggucgugucgucucacguaccuagauucgcuuuguccaauggaguucucuuugccaacuguauuucagugaccugccaaugucagacgaccggcagggcgaucagucagagcggugaacaaacacuguuaaugauugacaauacuaccugcccaacagccguccuggggaacgugaucauaucccuaggaaaguaccucggcucugucaauuacaacagcgagggcaucgcaauugggccgcccguguucacugauaagguugacaucucaagucagauuuccagcaugaaucagucucugcagcaaucaaaagauuauaucaaggaagcucagcggcuuuuggacaccgugaacccuagucugauaagcaugcucuccaugauuauccuguacguacuuucuauugccucgcugugcaucggauugauaacauuuaucagcuucauuaucgucgagaaaaagcgcaacaccuauucccgacucgaagauagaagggugcggccaacuucaaguggugaccuguacuauauuggcacguga

SEQ ID NO: 678 - RNA, 1563 nt, Artificial Sequence
  derived and/or modified CDS sequence (opt3) from Nipah henipavirus__AEZ01388__F(27-546) (FdelSS)
aucuuacacuacgaaaaacugucaaagauugggcuaguuaaaggaaucaccaggaaguauaaaauaaagaguaacccccucacaaaggacaucgugauuaaaaugaucccuaauguaagcaacaugucccaguguacugguucugugauggagaauuacaagacgcggcugaacggcauucuuaccccaaucaaaggggcucuggaaauauauaagaauaacacacaugauuuggucggagacgugcgccucgcaggcguuauuauggccgguguggcgaucgggauugcuacugccgcacaaaucaccgccggagucgcucuguacgaggcaaugaaaaaugccgauaacaucaauaagcugaagucgucaauugaaagcacaaacgaggcugugguaaaacuccaggagaccgccgaaaagacuguuuauguguuaacagcgcugcaggacuacauaaauaccaaccuugucccgacgaucgauaaaauuaguugcaagcagacugaguugucccuggaccuagcacucucuaaauaccugagcgaucuucuguucguguuuggccccaauuugcaagacccuguguccaacucaaugaccauccaggccauaagucaggcuuucggcgggaacuaugaaacacuccugcgaacuuuaggauacgccaccgaggauuuugacgaucugcucgagagcgacucuauuacaggucagaucaucuaugucgaucuuuccggcuacuauauuaucguucguguguacuucccaauucugaccgaaauacaacaggcauauauccaggaguugcuacccguaucauuuaauaacgacaauagcgaauggauuaguaucgugccuaacuucauccuggucagaaauacgcucauuucuaacauagagaucggguuuugucugauuacuaagagguccgugaucugcaaucaggacuacgcuacaccaaugaccaacaauaugcgggaaugucuuacuggaagcacagagaaaugcccccgcgagcugguugugucgucucacgucccuagauucgccuuguccaacggcgugcucuuugcgaauuguauuucaguaaccugccaaugucagacgaccgguagggccaucagucagagcggggaacaaacacuguuaaugauagauaacacuaccugcccaacagcaguucugggaaaugugaucauuucccuaggcaaguaccucggcucugucaacuauaauagcgaggggaucgcuauuggaccgcccguguucacugacaaggucgauaucucaagucagauauccagcaugaaccagucucugcagcaaucaaaagacuacauuaaggaagcccagcggcuuuuggauaccgugaacccuagucugaucagcaugcucuccaugauuauccuguauguucuuucuauagcuucgcuguguaucgguuugauuacauuuaucagcuucauuaucguggagaaaaagcgcaauaccuacucccgacucgaagacagaaggguacggccaacuucaaguggcgaucuguauuacauagggacguga

SEQ ID NO: 679 - RNA, 1563 nt, Artificial Sequence
  derived and/or modified CDS sequence (opt3) from Nipah henipavirus__AAY43915__F(27-546) (FdelSS)
auuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauacagcuccgaucugcuuuucguguuuggccccaaucugcaagacccugugucaaacaguaugaccauucaggccaucagccaggcuuucggcgggaacuaugaaacauugcuccgaacucugggauacgccaccgaggguuuugaugacuuacuggagucugauuccauaacaggccagauuaucuaugucgaccucucaggguacuauaucauuguucguguguacuucccaauccuuaccgaaauucaacaggcauauauacaggagcuguugcccguaaguuuuaauaacgauaauagugaauggaucucuauugugccuaacuucauccuagucagaaauacgcugaucuccaacauugagauaggauuuugucucaucacuaagaggagcgugauuugcaaucaggacuacgcuacaccaaugaccaacaauaugcgggaaugucugacuggcucgacagagaaaugcccccgcgagcuuguugugucuucccacgucccuagauucgcccugucaaacgguguguuguuugcgaauuguaucaguguaaccugccaaugucagacgaccgggagggccauuagccaguccggagaacaaacacuccugaugaucgacaacacuaccugcccaacagcaguuuuaggcaaugugauaaucucucugggcaaguaccuagggagcgucaacuauaauucagagggaauugcuaucgguccgcccguguucacugauaaggucgacauuaguucccagaucagcucuaugaaccagucacuccagcaaaguaaagauuacauaaaggaagcccagcggcugcuugacaccgugaacccuagcuugauuuccaugcugucuaugaucauucucuauguucugucgaucgcuagccuuuguauaggccugaucacauuuauuuccuucaucauuguggagaaaaagcgcaauaccuacucacgauuggaagauagaaggguacggccaacuagcucuggggaccucuauuacaucggaacguga

SEQ ID NO: 680 - RNA, 1563 nt, Artificial Sequence
  derived and/or modified CDS sequence (opt3) from Nipah henipavirus__CAF25496__F(27-546) (FdelSS)
auuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaucgaggacuuugaugaccugcucgagagugauagcauaaccggucagauuaucuacguggaccuuucuuccuauuacaucauuguacguguguauuucccaauccugacagaaauucaacaggccuacauacaggaguugcuacccgucucauuuaacaaugacaacagcgaauggaucaguauugugccuaauuucauccugguuagaaacacccucaucucuaauauugagauaggcuuuugucugaucacgaagagguccgugauuugcaaccaggauuaugcaacuccaaugacaaauaacaugcgggaaugucuuaccgggagcacugagaaaugcccccgcgagcuggucgugucgucucacguaccuagauucgcuuuguccaauggaguucucuuugccaacuguaucucagugacaugccaaugucagaccacgggcagggcgauuagucagagcggugaacaaacccuguuaaugaucgacaauacaacuugcccaaccgccguccuggggaacgugauaaucucccuaggaaaguaccucggcucugucaauuacaacagcgagggcauugcaaucgggccgcccguguucacagauaagguugacauuucaagucagaucuccagcaugaaucagucucugcagcaaucaaaagauuauauaaaggaagcucagcggcuuuuggacacugugaacccuagucugauuagcaugcucuccaugaucauucuguacguacuuucuaucgccucgcugugcauaggauugaucaccuuuauuagcuucaucauugucgagaaaaagcgcaacacauauucccgacucgaagauagaagggugcggccaaccucaaguggugaccuguacuauaucggcacuuga

SEQ ID NO: 681 - RNA, 1563 nt, Artificial Sequence
  derived and/or modified CDS sequence (opt3) from Nipah henipavirus__AAM13405__F(27-546) (FdelSS)
auuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaccgaggacuuugaugaccugcucgagagugauagcaucacaggucagauaauuuacguggaccuuucuuccuauuacaucaucguacguguguauuucccaauucugaccgaaauccaacaggccuacauucaggaguugcuacccgucucauuuaacaaugacaacagcgaauggauaaguaucgugccuaauuucauucugguuagaaacacgcucaucucuaauaucgagauuggcuuuugucugauaacuaagagguccgugaucugcaaccaggauuaugcaacaccaaccacuaauaacaugcgggaaugucuuacagggagcaccgagaaaugcccccgcgagcuggucgugucgucucacguaccuagauucgcuuuguccaauggaguucucuuugccaacuguauuucagugacgugccaaugucagaccacaggcagggcgaucagucagagcggugaacaaacucuguuaaugauugacaauaccacaugcccaacugccguccuggggaacgugaucauaucccuaggaaaguaccucggcucugucaauuacaacagcgagggcaucgcaauugggccgcccguguucaccgauaagguugacaucucaagucagauuuccagcaugaaucagucucugcagcaaucaaaagauuauaucaaggaagcucagcggcuuuuggacacagugaacccuagucugauaagcaugcucuccaugauuauccuguacguacuuucuauugccucgcugugcaucggauugauaaccuuuaucagcuucauuaucgucgagaaaaagcgcaacacuuauucccgacucgaagauagaagggugcggccaacgucaaguggugaccuguacuauauuggcacauga

SEQ ID NO: 682 - RNA, 1563 nt, Artificial Sequence
  derived and/or modified CDS sequence (opt3) from Nipah henipavirus__CBM41033__F(27-546) (FdelSS)
auuuuacacuaugaaaaacugucaaagaucgggcuagugaaaggaguaaccaggaaguacaaaauuaagaguaauccccucacaaaggauaucgugauaaaaaugaucgccaacgucagcaauaugucccagugcacugguucugugauggagaacuauaagacgcggcugaauggcauucuuaccccuaucaaaggggcucuggaaauuuacaagaacaauacacaugacuugguuggagaugugcgccucgcaggcgucaucauggccgguguggcgauagggauugcuacugccgcacaaaucaccgccggaguagcucuguaugaggcaaugaaaaacgccgacaauauuaacaagcugaagucgucaaucgaaagcacaaaugaggcuguugugaaacuccaggagaccgccgaaaagacugucuacguguuaacagcgcugcaggauuauaucaacaccaaucuugugccaacgauugacaaaauaaguuguaagcagacugaguugucccuggaucuagcacucucuaaauaccugagcgaccuucuguucgucuuuggcccgaacuugcaagaucccguuuccaauucaaugaccauccaggccauuagucaggcuuucggcgggaacuacgaaacacuccugcgaacuuuaggauaugccaccgaggacuuugaugaccugcucgagagcgauucuaucacaggucagauaauuuacguggaccuuuccucauauuacaucaucguacguguguauuucccuauucugaccgaaauccaacaggcauacauucaggaguugcuaccagucagcuuuaacaaugacaacagugaauggauaucuaucgugcccaauuucauucugguuagaaacacgcucaucuccaauaucgagauuggcuuuugccugauaacuaagaggagcgugaucuguaaccaggauuaugcuacaccuaugaccaauaacaugcgggaaugccuuacugggucgacagagaaauguccacgcgagcuggucgugucuucccacguacccagauucgccuugucaaauggaguucucuuugcgaacugcauuagugugaccugucaaugccagacgaccggcagggccaucagccaguccggugaacaaacacuguuaaugauugacaauacuaccuguccuacagcaguccuggggaacgugaucauaucucuaggaaaguaccucggcagcgucaauuacaacucagagggcaucgcuauugggccaccgguguucacugauaagguugacaucaguucccagaaaagcucuaugaaucagucacugcagcaaaguaaggauuauauuaaagaagcccagcggcuuuuggacaccgugaaccccagccugaucuccaugcucucuaugauaauucuguacguacuuucgaucgcuagccugugcauuggauugaucacauuuauauccuucaucauugucgagaagaaacgcaacaccuauucacgacucgaagauagaagggugcggccuacgaguucuggugaccuguacuauaucggcacuuga

SEQ ID NO: 683 - RNA, 1563 nt, Artificial Sequence
  derived and/or modified CDS sequence (opt3) from Nipah henipavirus__AEZ01396__F(27-546) (FdelSS)
auuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauaccugagcgaucuucuguucguguuuggccccaauuugcaagacccuguguccaacucaaugaccauucaggccaucagucaggcuuucggcgggaacuaugaaacacuccugcgaacuuuaggauacgccaccgaggauuuugacgaucugcucgagagcgacucuauaacaggucagauuaucuaugucgaucuuuccggcuacuauaucauuguucguguguacuucccaauccugaccgaaauucaacaggcauauauacaggaguugcuacccguaucauuuaauaacgacaauagcgaauggaucaguauugugccuaacuucauccuggucagaaauacgcucaucucuaacauugagauaggguuuugucugaucacuaagagguccgugauuugcaaucaggacuacgcuacaccaaugaccaacaauaugcgggaaugucuuacuggaagcacagagaaaugcccccgcgagcugguugugucgucucacgucccuagauucgccuuguccaacggcgugcucuuugcgaauuguaucucaguaaccugccaaugucagacgaccgguagggccauuagucagagcggggaacaaacacuguuaaugaucgauaacacuaccugcccaacagcaguucugggaaaugugauaaucucccuaggcaaguaccucggcucugucaacuauaauagcgaggggauugcuaucggaccgcccguguucacugacaaggucgauauuucaagucagaucuccagcaugaaccagucucugcagcaaucaaaagacuacauaaaggaagcccagcggcuuuuggauaccgugaacccuagucugauuagcaugcucuccaugaucauucuguauguucuuucuaucgcuucgcuguguauagguuugaucacauuuauuagcuucaucauuguggagaaaaagcgcaauaccuacucccgacucgaagacagaaggguacggccaacuucaaguggcgaucuguauuacaucgggacguga

SEQ ID NO: 684 - RNA, 1563 nt, Artificial Sequence
  derived and/or modified CDS sequence (opt3) from Hendra henipavirus__NP_047111__F(27-546) (FdelSS)
auacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauugcugggcaaaucguguauguagauuugagcucuuacuauauaauugugcgagucuacuucccaauccuaaccgagauccagcaggccuaugugcaggaacugcuccccguuuccuuuaacaacgacaauucagaguggauuagcaucgugccuaacuucguccugauucguaauacgcuuauaaguaacaucgaagugaaguacugccugauuacuaaaaagucuguaaucuguaaucaagacuaugcgacaccaaugaccgccuccguuagagagugcuugacuggaagcacagauaagugucccagggagcucguggucucgucucacgugccucgguuugcacuguccggcggugucuuauucgcuaacugcaucucagugaccugucagugccagacgaccgggcgcgccauuagucaaagcggagaacagacacugcuaaugauagacaauacuaccuguacaacuguugugcucggcaacaucauuaucucccugggcaaauaccuugggucuauuaauuacaacagcgagucaaucgcuguaggaccaccggucuauaccgauaagguggacauaaguucccagaucagcucuaugaaucagucauugcaacagaguaaagauuacauuaaggaagcccagaaaauccuggacacaguuaaccccagccucauuuccaugcugucuaugaucauacuuuaugugcugucgauugcagccuugugcaucggucucauuaccuuuaucagcuucgucauaguggagaagaagagaggcaauuacuccaggcuggaugaccggcagguacgcccugugucaaacggggauuuauauuacaucggaacuuga

SEQ ID NO: 685 - RNA, 1563 nt, Artificial Sequence
  derived and/or modified CDS sequence (opt3) from Hendra henipavirus__AEB21233__F(27-546) (FdelSS)
auacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauuaccgggcaaaucguguauguagauuugagcucuuacuauauaauugugcgagucuacuucccaauccuaacggagauccagcaggcuuaugugcaggaacugcuccccguuuccuuuaacaacgacaauucagaguggauuagcaucgugccuaacuucguccugauucguaauacucuuauaaguaacaucgaagugaaguacugccugauuaccaaaaagucuguaaucuguaaucaagacuaugccacaccaaugacugcguccguuagagagugcuugacaggaagcaccgauaagugucccagggagcucguggucucgucucacgugccucgguuugcccuguccggcggugucuuauucgcaaacugcaucucagugacgugucagugccagaccacagggcgcgcuauuagucaaagcggagaacagacucugcuaaugauagacaauaccacauguacuaccguugugcucggcaacaucauuaucucccugggcaaauaccuugggucuauuaauuacaacagcgagucaaucgccguaggaccaccggucuauacagauaagguggacauaaguucccagaucagcucuaugaaucagucauugcaacagaguaaagauuacauuaaggaagcucagaaaauccuggacaccguuaaccccagccucauuuccaugcugucuaugaucauacuuuaugugcugucgauugccgcauugugcaucggucucauuacuuuuaucagcuucgucauaguggagaagaagagaggcaauuacuccaggcuggaugaccggcagguacgcccugugucaaacggggauuuauauuacaucggaacguga

SEQ ID NO: 686 - RNA, 1566 nt, Artificial Sequence
  derived and/or modified CDS sequence (opt3) from Hendra henipavirus__AEQ38114__F(26-546) (FdelSS)
ggaauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauuaccgggcaaaucguguauguagauuugagcucuuacuauauaauugugcgagucuacuucccaauccuaacggagauccagcaggcuuaugugcaggaacugcuccccguuuccuuuaacaacgacaauucagaguggauuagcaucgugccuaacuucguccugauucguaauacucuuauaaguaacaucgaagugaaguacugccugauuaccaaaaagucuguaaucuguaaucaagacuaugccacaccaaugacugcguccguuagagagugcuugacaggaagcaccgauaagugucccagggagcucguggucucgucucacgugccucgguuugcccuguccggcggugucuuauucgcaaacugcaucucagugacgugucagugccagaccacagggcgcgcuauuagucaaagcggagaacagacucugcuaaugauagacaauaccacauguacuaccguugugcucggcaacaucauuaucucccugggcaaauaccuugggucuauuaauuacaacagcgagucaaucgccguaggaccaccggucuauacagauaagguggacauaaguucccagaucagcucuaugaaucagucauugcaacagaguaaagauuacauuaaggaagcucagaaaauccuggacaccguuaaccccagccucauuuccaugcugucuaugaucauacuuuaugugcugucgauugccgcauugugcaucggucucauuacuuuuaucagcuucauaaucgucgagaagaagagaggcaauuacuccaggcuggaugaccgccaggugcggccuguaucaaacggggauuuauauuacauuggaacguga

SEQ ID NO: 687 - RNA, 1563 nt, Artificial Sequence
  derived and/or modified CDS sequence (opt3) from Hendra henipavirus__AAB39505__F(27-546) (FdelSS)
auacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguugauaugcuccuguuucgggcccaaucuccaggauccugucucuaacagcaugacaauccaggcuauuucccaggccuuuggagguaauuacgagacucuguuacgcacccugggcuacgcaacagaggacuucgaugaccuccuugaaucagauaguaucaccgggcaaauaguuuauguggaccugagcucuuacuauauuaucguacgaguguacuuuccaaucuugacggagauucagcaggcuuauguccaggaacuacugcccguguccuucaacaacgauaauucagaguggaucagcauuguuccuaacuuugugcucauacguaauacucugaucaguaacauugaagucaaguacugccuuaucacaaagaagucugugaucuguaaucaagacuaugccaccccaaugacugcguccguaagagagugccugacaggaagcaccgacaagugucccagggaguugguugugucgucucacgucccucgguucgcccucuccggcggugugcuguuugcaaacugcauuucagucacgugucagugccagaccacagggcgcgcuauaagucaaagcagagaacagacuuuacugaugaucgauaauaccacaugcacuaccgugguucuaggaaacauuaucauuucccucccaaaauaccugggcucuaucaaacuucagguguugagggcccugcuccugggccaucagagcauacaaacaaaaguagacaucucaagucagauuuccagcaugaaucagucucuucagcaaucaaaggauuacaucaaagaggcucagaagauucuggacaccgucaacccgaguuugaucagcaugcucuccaugauaauucuguauguguuaucuaucgccgcacuguguauugggcuaaucacuuucauaucguuuguuaucguggaaaagaaacggggaaauuacagccgccucgaugaccgacaggucagacccguguccaacggugaucuguauuacauuggcacguga

SEQ ID NO: 688 - RNA, 1599 nt, Artificial Sequence
  derived and/or modified CDS sequence (opt3) from Nipah henipavirus__AAK50554__G(70-602) (solG)
cagaauuacaccagguccacagauaaccaagccgugauuaaggacgcguuacagggcauccagcagcaaauaaaagggcuggcugauaagauuggaacugaaaucggcccaaaagucucucuaauugacaccucgucaacaaucaccaucccggccaauauuggucuccuggggagcaagauaagucaguccacugcaucuaucaacgagaaugugaacgaaaagugcaaauucacacuucccccucugaagauucacgaguguaauaucagcugcccaaaccccuugccuuuucgggaguaucgcccacagaccgaaggaguuuccaaucucgugggccugcccaacaauauaugucugcagaaaacgucaaaccaaauucucaagccuaaauuaaucaguuacacucugccagucgugggccagagcgggaccugcaucacagauccgcuuuuggccauggacgagggauauuucgcuuacucucaucuggaacgaauugguuccuguucacguggcguaagcaagcagagaaucauugggguuggagaggugcuagauaggggcgacgagguccccagucucuuuaugacuaacguguggaccccuccaaaucccaacacaguguaucacugcucugcagucuacaauaacgaguucuacuauguucugugugccguguccaccguaggugauccuauacuuaauagcacguacuggucggggucucugaugaugacucgguuggcugugaaaccaaaguccaacggaggcggcuauaaucagcaucaacucgcccugcgcucaaucgaaaaggggagauacgacaaagucaugcccuauggaccgagugguauuaagcagggcgauacauuauacuuuccugcggugggguuccugguuaggaccgaauuuaaauauaacgacagcaauugccccaucacuaagugucaguacuccaaaccagagaacugccggcucucuaugggaauccgcccuaauagccacuacauucuucgaucaggccuguugaaguauaaccuaagugacggugaaaaucccaagguggucuucauagagaucuccgaucaaagacugagcauugggucuccaucaaaaaucuacgacagucucggccagcccguguuuuaucaggccagcuucuccugggauacaaugauuaaguuuggagacguacugaccguuaacccucuuguggucaauuggaggaacaacacggugaucucucggccaggccagucgcaauguccgcguuucaauaccugccccgagauaugcugggaaggggucuacaacgaugcauuccugaucgaccgcauuaauuggaucagcgcuggaguguuuuuggauuccaaccagacagccgagaauccuguuuucacuguguuuaaagacaacgaaauucucuauagagcacagcuggcuucagaggauaccaaugcccagaagacaaucacuaacuguuucuuacugaaaaauaagauauggugcauuagucuaguagaaaucuacgacaccggugauaacgucauuaggccaaagcucuuugcggugaaaauccccgagcaauguacauga

SEQ ID NO: 689 - RNA, 1599 nt, Artificial Sequence
  derived and/or modified CDS sequence (opt3) from Nipah henipavirus__AEZ01389__G(70-602) (solG)
cagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccauucuuaauuccaccuacuggucagguagucugaugaugacgagauuggcugugaagccuaaaaacaauggggaaagcuauaaccagcaucaauuugcccucaggaauauagaaaagggaaaauacgacaaggucaugccauauggccccuccggcaucaaacagggggauacucuguacuucccggcggugggauuuuuaguucggacagaguucaaguauaacgacucuaauugcccuauugcagaaugucaguacagcaagcccgagaacugccgccugucaauggguaucagaccaaauagucacuacauccucagguccggccuucugaaauauaacuugagcgacgaggaaaauucuaagauuguguuuauagagaucucagaucaacggcuaaguauugggagcccuuccaaaaucuacgacucucugggacagcccgucuucuaucaggccucguuuagcugggauaccaugauuaaguucggcgacgugcagacuguaaacccacucguugugaacuggcgcgauaauacagucaucucccgacccggucaaucacaguguccuagauucaacaaaugcccagaagugugcugggagggggucuacaaugacgcuuuucugauagauaggaucaacuggauuagugccggcguguuccuugacucuaaucagaccgcagaaaacccgguuuuuacgguguucaaggauaaugagguacuguaucgggcucaguuggccagcgaggacaccaacgcgcaaaagacaaucacuaauuguuuucuccugaaaaacaagauuuggugcaucuccuuagucgaaauauacgauaccggagacaaugugauucgucccaaacuguucgccguuaagaucccugagcaguguacauga

SEQ ID NO: 690 - RNA, 1599 nt, Artificial Sequence
  derived and/or modified CDS sequence (opt3) from Nipah henipavirus__ACT32615__G(70-602) (solG)
cagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccgugcuuaauuccaccuacuggucagguagucugaugaugacgagauuggcugucaagccuaaaaacaauggggaaagcuauaaccagcaucaauuugcccucaggaauauugaaaagggaaaauacgacaaggugaugccauauggccccuccggcauaaaacagggggauacucuguacuucccggcgguuggauuuuuagugcggacagaguucaaguauaacgacucuaauugcccuaucgcagaaugucaguacagcaagcccgagaacugccgccugucaauggguauuagaccaaauagucacuacauccucagguccggccuucugaaauauaacuugagcgacgaggaaaauucuaagaucgucuuuauugagauaucagaucaacggcuaaguaucgggagcccuuccaaaauuuacgacucucugggacagcccguguucuaucaggccucguuuagcugggauaccaugaucaaguucggcgacguacagacuguuaacccacucguggucaacuggcgcgauaauacagugauuucccgacccggucaaucacaguguccuagauucaacaaaugcccagaagucugcugggaggggguguacaaugacgcuuuucugaucgauaggauaaacuggaucagugccggcguuuuccuugacucuaaucagaccgcagaaaacccgguguuuacgguauucaaggauaaugagguccuguaucgggcucaguuggccagcgaggacaccaacgcgcaaaagacaauuacuaauuguuuucuccugaaaaacaagaucuggugcauuuccuuaguggaaaucuacgauaccggagacaauguuauacgucccaaacuguucgccgugaagauuccugagcaguguacauga

SEQ ID NO: 691 - RNA, 1599 nt, Artificial Sequence
  derived and/or modified CDS sequence (opt3) from Nipah henipavirus__CAF25497__G(70-602) (solG)
cagaacuacaccagguccacagauaaucaagccgugaucaaggacgcguuacagggcauucagcagcaaaucaaagggcuggcugauaagauaggaacugaaauuggcccaaaagucucucuaaucgacaccucgucaacaauuaccaucccggccaacaucggucuccuggggagcaagauuagucaguccacugcaucuauaaaugagaacgugaaugaaaagugcaaauucacacuucccccucugaagauccacgaguguaacauuagcugcccaaaucccuugccuuuucgggaguaucgcccacagaccgaaggaguuuccaaccucgugggccugcccaauaacaucugucugcagaaaacgucaaaccaaauacucaagccuaaauuaauuaguuacacucugccagucgugggccagagcgggaccugcaucacagauccgcuuuuggccauggacgagggauauuucgcuuacucucaucuggaacgaaucgguuccuguucacguggcguaagcaagcagagaauuaucgggguuggagaggugcuagauaggggcgacgagguccccagucucuuuaugacuaaugugugggcaccuccaaaccccaauaccguguaucacugcucugccgucuacaacaaugaguucuacuauguucugugugcuguguccacaguaggugauccuauucuuaacagcaccuacuggucggggucucugaugaugacgcgguuggccgugaaaccaaaguccaauggaggcggcuauaaccagcaucaacucgcgcugcgcucaauagaaaaggggagauacgacaaagucaugcccuauggaccgagugguaucaagcagggcgauacuuuauacuuuccugcagugggguuccugguuaggacagaauuuaaauauaaugacagcaacugccccauuaccaagugucaguacuccaaaccagagaauugccggcucucuaugggaauccgcccuaacagccacuacauccuucgaucaggccuguugaaguauaaucuaagugacggugaaaaccccaagguggucuucauugagauauccgaucaaagacugagcaucgggucuccaucaaaaauuuacgacagucucggccagcccguguuuuaucaggccagcuucuccugggauacuaugaucaaguuuggagacguacugacaguuaauccucuuguggucaacuggaggaacaauaccgugauuucucggccaggccagucgcaauguccgcguuucaacacgugccccgagaucugcugggaaggggucuacaaugaugcuuuccugauagaccgcaucaacuggauuagcgccggaguguuuuuggauuccaaucagaccgcagagaacccuguuuucacaguguuuaaagacaaugaaauccucuauagagcucagcuggccucagaggauacuaacgcgcagaagaccauuacaaauuguuucuuacugaaaaacaagaucuggugcauaagucuaguagaaauuuacgacacuggugauaaugucaucaggccaaagcucuuugccgugaaaauucccgagcaauguaccuga

SEQ ID NO: 692 - RNA, 1599 nt, Artificial Sequence
  derived and/or modified CDS sequence (opt3) from Nipah henipavirus__CBM41034__G(70-602) (solG)
cagaacuacaccagguccacagauaaucaagccgugaucaaggacgcguuacagggcauucagcagcaaaucaaagggcuggcugauaagauaggaacugaaauuggcccaaaagucucucuaaucgacaccucgucaacaauuaccaucccggccaacaucggucuccuggggagcaagauuagucaguccacugcaucuauaaaugagaacgugaaugaaaagugcaaauucacacuucccccucugaagauccacgaguguaacauuagcugcccaaaucccuugccuuuucgggaguaucgcccacagaccgaaggaguuuccaaccucgugggccugcccgauaauaucugucugcagaaaacgucaaaccaaauacucaagccuaaauuaauuaguuacacucugccagucgugggccagagcgggaccugcaucacagacccgcuuuuggccauggaugagggauauuucgcuuacucucaucuggaacgaaucgguuccuguucacguggcguaagcaagcagagaauuaucgggguuggagaggugcuagacaggggcgaugagguccccagucucuuuaugacuaacguguggaccccuccaaaucccaacacaguguaucacugcucugcagucuacaauaacgaguucuacuauguucugugugccguguccaccguaggugacccuauucuuaauagcacguacuggucggggucucugaugaugacucgguuggcugugaaaccaaaguccaacggaggcggcuauaaucagcaucaacucgcccugcgcucaauagaaaaggggagauacgauaaagucaugcccuauggaccgagugguaucaagcagggcgacacauuauacuuuccugcggugggguuccugguuaggaccgaauuuaaauauaacgacagcaauugccccauuacuaagugucaguacuccaaaccagagaacugccggcucucuaugggaauccgcccuaauagccacuacauccuucgaucaggccuguugaaguauaaccuaagugauggugaaaaucccaagauuguguucauagagaucuccgaccaaagacugagcauugggucuccaucaaaagucuacgauagucucggccagcccguguuuuaucaggccagcuucuccugggacacaaugaucaaguuuggagauguacagaccguuaacccucugguggucaauuggagggacaacacggugauuucucggccaggccaaucgcaguguccgcguuucaauaccugccccgagaucugcugggaaggggucuacaacgaugcauuccuuauagaccgcaucaacuggauuagcgcuggaguguuucuggauuccaaucagacagccgagaacccuguuuucacuguguuuaaagacaaugaaaucuuguauagagcacagcucgcuucagaggauaccaacgcccaaaagacaauuacuaauuguuuccugcugaaaaacaagaucuggugcauaaguuuaguagaaauuuacgacaccggugacaaugucaucaggccaaagcuauuugcggugaaaauucccgagcaguguacauga

SEQ ID NO: 693 - RNA, 1599 nt, Artificial Sequence
  derived and/or modified CDS sequence (opt3) from Nipah henipavirus__AAX51853__G(70-602) (solG)
cagaacuacaccaggucuacagauaaucaagccguaaucaaggacgcguuacagggcauacagcagcaaauuaaagggcuggcugauaagaucggaacugaaauuggcccaaaagugucgcuaaucgacaccucaagcacaaucaccauuccggccaacauaggucuccuggggaguaagaucucccagucuacugcaagcauuaaugagaacgucaaugaaaagugcaaauucacacuucccccucugaagauccacgaguguaacauauccugcccaaaucccuugccuuuucgggaguaucgcccacagaccgaaggagugucaaaccucguuggccugcccaauaacauuugucugcagaaaacgaguaaucaaauccucaagccuaaauuaaucagcuacacucugccaguggucggccagucugggaccugcauuacagauccgcuuuuggccauggacgagggauauuucgcuuacucccaucuggaacgaaucgguucauguagccguggcgugaguaagcagaaaauuauagggguaggagagguucuagauagaggcgacgaggugcccucucucuuuaugacuaacgucuggaccccuccaaaccccaauacaguguaucacugcuccgcaguguacaacaaugaguucuacuauguccugugugccguuagcaccgugggugauccuauccuuaacucgacguacuggucugggucccugaugaugacuagguuggcuguaaagccaaagucaaaugacggaggcuauaaccagcaucaacucgcccugcggaguauugaaaaaggccgcuacgauaaggugaugcccuaugggccgagcggaaucaaacagggugacacauuauacuuuccugcggucggcuuccuggugagaaccgaauuuaaguauaaugacuccaacugccccaucacuaaaugucaguacucuaagccagagaauugcaggcucagcauggggauucggccuaacucacacuacguucuucgcaguggacuguugaaguauaaucuauccgauggcgaaaaccccaaaauaguguucaucgagauuagcgaccaacgacugucuaucgguucaccaaguaagauuuacgauagccucgggcagcccgucuuuuaucaggcauccuucucuugggacacaaugaucaaauuuggcgaugugcagaccguaaauccucugguugugucguggagagacaacacggucauaagcaggccaggacaaucccaguguccgcgguucaauaccugccccgagaucugcugggaaggcguguacaacgaugccuuccuuauugaccguaucaacuggauuucagcuggggucuuucuggauaguaaucagacagccgagaacccuguguucacuguuuuuaaggacaaugaaaucuuguaucgcgcacagcucgcuucugaggauaccaacgcccagaaaacaauaacuaauuguuuccuguuaaagaacaagauuuggugcaucagccugguggaaauuuacgacaccggagacaauguaaucagaccaaaacuauuugcggucaagauacccgagcaauguacauga

SEQ ID NO: 694 - RNA, 1599 nt, Artificial Sequence
  derived and/or modified CDS sequence (opt3) from Nipah henipavirus__AEZ01397__G(70-602) (solG)
cagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccauucuuaauuccaccuacuggucagguagucugaugaugacgagauuggcugugaagccuaaaaacaauggggaaagcuauaaccagcaucaauuugcccucaggaauauagaaaagggaaaauacgacaaggucaugccauauggccccuccggcaucaaacagggggauacucuguacuucccggcggugggauuuuuaguucggacagaguucaccuauaacgacucuaauugcccuauugcagaaugucaguacagcaagcccgagaacugccgccugucaauggguaucagaccaaauagucacuacauccucagguccggccuucugaaguauaacuugagcgacgaggaaaauucuaaaauuguguuuauagagaucucagaucaacggcuaaguauugggagcccuuccaagaucuacgacucucugggacagcccgucuucuaucaggccucguuuagcugggauacuaugauuaaauucggcgacgugcagacaguaaacccacucguugugaacuggcgcgauaauaccgucaucucccgacccggucaaucacaguguccuagauucaacaagugcccagaagugugcugggagggggucuacaaugacgcuuuucugauagauaggaucaacuggauuagugccggcguguuccuugacucuaaucagacggcagaaaacccgguuuuuaccguguucaaagauaaugagguacuguaucgggcucaguuggccagcgaggacacaaacgcgcaaaagacuaucaccaauuguuuucuccugaagaacaaaauuuggugcaucuccuuagucgaaauauacgauacaggagacaaugugauucgucccaagcuguucgccguuaaaaucccugagcaguguacuuga

SEQ ID NO: 695 - RNA, 1605 nt, Artificial Sequence
  derived and/or modified CDS sequence (opt3) from Hendra henipavirus__NP_047112__G(70-604) (solG)
caaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauagccaucacaaaggucgaaagagggaaauacgauaagguuaugccuuauggaccauccggcauuaaacaaggcgacacccucuacuuucccgcugugggguuccuuccgaggacggaguuucaguauaaugauucuaacugcccuaucauucacuguaaguacagcaaagccgagaauugccggcugucaaugggaguaaacaguaagucccacuauaucuugcgcagcggucuacugaaguacaaucucucucugggcggggacauaauccuucaguucauugaaaucgcggauaaccgacugaccauuggaucacccaguaaaaucuacaauagcuugggccaaccaguguuuuaucaggcauccuacucuugggacacaaugauaaagcucggugaugucgacacuguggauccucugagaguucaguggaggaacaauucggugauuagccggcccgggcagucccaauguccacguuucaacgucugccccgaggugugcugggaaggcaccuauaaugacgccuuuuuaaucgaccgccugaacuggguaucagcuggaguuuaccuaaacaguaaucagacagccgagaacccuguguucgcagucuucaaagauaaugaaauucucuaucaggugccacuggcugaggacgauacuaacgcccagaagaccaucacagacuguuuucuuuuggagaaugucauauggugcaucucucugguggaaauuuacgauaccggcgacagcguuaucagaccgaaacucuucgcggugaagauucccgcccaauguuccgagucauga

SEQ ID NO: 696 - RNA, 1605 nt, Artificial Sequence
  derived and/or modified CDS sequence (opt3) from Hendra henipavirus__AEB21225__G(70-604) (solG)
caaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauagccaucacaaaggucgaaagagggaaauacgauaagguuaugccuuauggaccauccggcauuaaacaaggcgacacccucuacuuucccgcugugggguuccuuccgaggacggaguuucaguauaaugauucuaacugcccuaucauucacuguaaguacagcaaagccgagaauugccggcugucaaugggaguaaacaguaagucccacuauaucuugcgcagcggucuacugaaguacaaucucucucugggcggggacauaacccuucaguucaucgaaauugcggauaaccgacugacaaucggaucacccaguaaaauuuacaauagcuugggccaaccaguguuuuaucaggcauccuacucuugggacacuaugaucaagcucggugaugucgacaccguggauccucugagaguucaguggaggaacaauucggugauaagccggcccgggcagucccaauguccacguuucaacgucugccccgaggugugcugggaaggcacauauaaugacgccuuuuuaauugaccgccugaacuggguaucagcuggaguuuaccuaaacaguaaucagacugccgagaacccuguguucgcagucuucaaagauaaugaaauccucuaucaggugccacuggcugaggacgauaccaacgcccagaagacaauuaccgacuguuuucuuuuggagaaugucaucuggugcauaucucugguggaaaucuacgauacuggcgacagcguuauuagaccgaaacucuucgcggugaagauccccgcccaauguuccgagucauga

SEQ ID NO: 697 - RNA, 1605 nt, Artificial Sequence
  derived and/or modified CDS sequence (opt3) from Hendra henipavirus__AEB21216__G(70-604) (solG)
caaaauuacacuagaacgaccgauaaccaggcccuaaucaaagagagccuccaguccguacagcaacagauaaaggcgcugacagacaaaauuggaacugaaaucggcccuaaggugucucuuauugauaccucgucaacaaucaccaucccagcuaauauuggucuguuggggagcaaaauaagucaguccacuucuagcaucaacgagaaugucaacgacaagugcaaguuuacacucccgccccugaaaauucacgaauguaauaucuccugcccuaacccacugcccuucagggaguaucggccuauaucacagggagugagugaucucguuggcuuaccaaaucaaauuugucugcagaagaccacgagcacuauccuuaaaccccgcuugaucucuuacacccugccuauuaacacacgagaaggcgugugcaucacugacccacuacucgccgucgauaacggguuuuucgcauauucccaucuggagaagauuggaucauguacccgugguauagccaaacagagaaucauuggcgugggggagguacuugacaggggagauaagguuccgagcauguuuaugacaaauguguggacgcccccuaacccaaguaccauccaccauuguucuuccacuuaccacgaagacuucuauuacacacugugcgcugucagccaugugggcgaccccauccucaauucgaccucuuggacugaguccuugucacugauucgguuagcagugcgcccuaaaagugauagcggugacuacaaccagaaguauauagccaucaauaaggucgaaagagggaaauacgauaagguuaugccauauggacccuccggcauuaaacaaggcgacacacuguacuuuccggcugugggguuccucccuaggaccgaguuucaguauaacgauucuaauugccccaucauucacuguaaguacagcaaagccgagaacugccggcuuucaaugggaguaaauaguaagucccacuauauccugcgcagcgguuugcuaaaguacaaccugucucucggcggggacauaauccugcaguucauugaaaucgcggauaaucgacuuacgauuggaucaccaaguaaaaucuacaacagccugggccaaccuguguuuuaucaggcauccuacucuugggacaccaugauaaaguugggugaugucgacacaguggauccccucagaguucaguggaggaauaacucggugauuagccggccagggcagucccaauguccccguuucaaugucugcccugaggugugcugggaaggcacuuauaacgacgccuuucugaucgaccgcuuaaacuggguaucagcuggaguuuaccugaauaguaaccagaccgccgagaauccaguguucgcagucuucaaagauaacgaaauucuauaucaggugccgcucgcugaggacgauacaaaugcccagaagacuaucaccgacuguuuucugcuugagaacgucauauggugcaucucuuugguggaaauuuacgauacaggcgacagcguuaucagacccaaacuguucgcggugaagauuccugcccaauguuccgagucauga

SEQ ID NO: 698 - RNA, 1605 nt, Artificial Sequence
  derived and/or modified CDS sequence (opt3) from Hendra henipavirus__AEB21206__G(70-604) (solG)
caaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcgguaacuacaaucagaaguauauagccaucacaaaggucgaaagagggaaauacgacaagguuaugccuuauggaccauccggcauuaaacaaggcgauacccucuacuuucccgcugugggguuccuuccgaggacggaguuucaguauaacgacucuaauugcccuaucauucacuguaaguacagcaaagccgagaacugccggcugucaaugggaguaaauaguaagucccacuauaucuugcgcagcggucuacugaaguacaaccucucucugggcggggauauaauccuucaguucauugaaaucgcggacaaucgacugaccauuggaucacccaguaaaaucuacaacagcuugggccaaccaguguuuuaucaggcauccuacucuugggauacaaugauaaagcucggugacauugauacugucgacccucugagagugcaguggaggaauaacucgguuaucagccggcccgggcagucccaauguccacguuucaaugugugccccgaggucugcugggaaggcaccuauaacgaugccuuuuuaauugaccgccugaacugggugucagcuggaguauaccuaaauaguaaccagacagccgagaauccuguuuucgcaguguucaaagacaacgaaauccucuaucaggucccacuggcugaggaugacacuaaugcccagaagaccauaacagauuguuuucuuuuggagaacgugaucuggugcauuucucuggucgaaaucuacgacaccggcgauagcgugauuagaccgaaacucuucgcgguuaagauccccgcccaauguuccgagucauga

SEQ ID NO: 699 - RNA, 1605 nt, Artificial Sequence
  derived and/or modified CDS sequence (opt3) from Hendra henipavirus__AEQ38052__G(70-604) (solG)
caaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauaacaaucaccaaggucgaaagagggaaauacgauaagguuaugccuuauggaccauccggcauuaaacaaggcgacacgcucuacuuucccgccgugggguuccuuccgaggaccgaguuucaguauaaugauucuaacugcccuaucauucacuguaaguacagcaaagcugagaauugccggcugucaaugggaguaaacaguaagucccacuauaucuugcgcagcggucuacugaaguacaaucucucucugggcggggacauaauccuucaguucauugaaaucgccgauaaccgacugacaauuggaucacccaguaaaaucuacaauagcuugggccaaccaguguuuuaucaggcguccuacucuugggacacuaugauaaagcucggugaugucgacaccguggauccucugagaguucaguggaggaacaauucggugauuagccggcccgggcagucccaauguccacguuucaacgucugccccgaggugugcugggaaggcacauauaaugacgcauuuuuaaucgaccgccugaacuggguaucagccggaguuuaccuaaacaguaaucagacugcugagaacccuguguucgccgucuucaaagauaaugaaauucucuaucaggugccacuggcagaggacgauaccaacgcucagaagacaaucaccgacuguuuucuuuuggagaaugucauauggugcaucucucugguggaaauuuacgauacuggcgacagcguuaucagaccgaaacucuucgccgugaagauucccgcgcaauguuccgagucauga

SEQ ID NO: 700 - RNA, 1605 nt, Artificial Sequence
  derived and/or modified CDS sequence (opt3) from Hendra henipavirus__AEQ38115__G(70-604) (solG)
caaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauaacggugacuacaaucagaaguauauagccaucacaaaggucgaaagagggaaauacgauaagguuaugccuuauggaccaagcggcauuaaacaaggcgacacccucuacuuucccgcugugggguuccuuccgaggacggaguuucaguauaacgauuccaauugcccuaucauucacuguaaguacucuaaagccgagaacugccggcugagcaugggaguaaauucaaagagucacuauaucuugcgcuccggucuacugaaguacaaccucagccugggcggggacauaauccuucaguucauugaaaucgcggauaaucgacugaccauuggaucucccucaaaaaucuacaacaguuugggccaaccaguguuuuaucaggcaagcuacuccugggacacaaugauaaagcucggugaugucgacacuguggauccucugagaguucaguggaggaauaacucugugauuucgcggcccgggcagagccaauguccacguuucaaugucugccccgaggugugcugggaaggcaccuauaacgacgccuuuuuaaucgaccgccugaacuggguauccgcuggaguuuaccuaaauucaaaccagacagccgagaauccuguguucgcagucuucaaagauaacgaaauucucuaucaggugccacuggcugaggacgauacuaaugcccagaagaccaucacagacuguuuucuuuuggagaacgucauauggugcaucagucugguggaaauuuacgauaccggcgacucuguuaucagaccgaaacucuucgcggugaagauucccgcccaauguagcgaguccuga

SEQ ID NO: 701 - RNA, 1605 nt, Artificial Sequence
  derived and/or modified CDS sequence (opt3) from Hendra henipavirus__AEQ38108__G(70-604) (solG)
caaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauaacaaucaccaaggucgaaagagggaaauacgauaagguuaugccuuauggaccauccggcauuaaacaaggcaauacgcucuacuuucccgccgugggguuccuuccgaggaccgaguuucaguauaacgacucuaauugcccuaucauucacuguaaguacagcaaagcugagaacugccggcugucaaugggaguaaauaguaagucccacuauaucuugcgcagcggucuacugaaguacaaccucucucugggcggggauauaauccuucaguucauugaaaucgccgacaaucgacugacaauuggaucacccaguaaaaucuacaacagcuugggccaaccaguguuuuaucaggcguccuacucuugggauacuaugauaaagcucggugacgucgauaccguggacccucugagaguucaguggaggaauaacucggugauuagccggcccgggcagucccaauguccacguuucaaugucugccccgaggugugcugggaaggcacauauaacgaugcauuuuuaaucgaccgccugaacuggguaucagccggaguuuaccuaaauaguaaccagacugcugagaauccuguguucgccgucuucaaagacaacgaaauucucuaucaggugccacuggcagaggaugacaccaaugcucagaagacaaucaccgauuguuuucuuuuggagaacgucauauggugcaucucucugguggaaauuuacgacacuggcgauagcguuaucagaccgaaacucuucgccgugaagauucccgcgcaauguuccgagucauga

SEQ ID NO: 702 - RNA, 1605 nt, Artificial Sequence
  derived and/or modified CDS sequence (opt3) from Hendra henipavirus__AAV80426__G(70-604) (solG)
caaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucagugcacuuccucuaucaacgagaaugucaacgacaaguguaaguuuacacugccaccgcugaaaauucacgaaugcaauaucagcugucccaacccucucccauucagggaguaucggcccauaucccagggagugucagauuuaguuggccugccuaaucaaauuugccuucagaagaccacgaguacuaucuugaaaccacgccugaucagcuacacccuacccauuaacacacgagaaggcguguguaucacugacccucuccuggccgucgauaacggguuuuucgcauauucucaucuugagaagauuggauccugcacccgugguauagccaaacagagaaucauuggcgugggggagguacuggacaggggagauaagguuccaucaauguuuaugacaaauguguggaccccgcccaacccuagcacgauccaccauuguaguucuacuuaccacgaagacuucuauuacacauugugcgcugucucccaugugggcgacccaauccucaauagcaccucguggacugagucucuguccuuaauucggcuggcagugcgccccaaaucagauaguggugacuacaaccagaaguauauagccaucacaaaggucgaaagagggaaauacgauaagguuaugccuuauggaccaagcggcauuaaacaaggcgacacccucuacuuucccgcugugggguuccuuccgaggacggaguuucaguauaaugauuccaacuguccuaucauucacugcaaguacucuaaagccgagaauugucggcugagcaugggaguaaacucaaagagucacuauaucuugcgcuccggucuacugaaguacaaucucagccugggcggggacauaauccuucaguucauugaaaucgcggauaaccgacugaccauuggaucucccucaaaaaucuacaauaguuugggccaaccaguguuuuaucaggcaagcuacuccugggacacaaugauaaagcucggugaugucgacacuguggauccucugagaguucaguggaggaacaauucugugauuucgcggcccgggcagagccaaugcccacguuucaacgucugccccgagguguguugggaaggcuccuauaaugacgccuuuuuaaucgaccgccugaacuggguaucagcuggaguuuaccuaaacaguaaucagaccgccgagaacccuguguucgcagucuucaaagauaaugaaauucucuaucaggugccacuggcugaggacgauacaaacgcccagaagacuaucaccgacugcuuucuuuuggagaaugucauaugguguaucucucugguggaaauuuacgauacaggcgacagcguuaucagaccgaaacucuucgcggugaagauucccgcccaaugcuccgagucauga

SEQ ID NO: 703 - RNA, 1563 nt, Artificial Sequence
  derived and/or modified CDS sequence (opt4) from Nipah henipavirus__AAK50553__F(27-546) (FdelSS)
auccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 704 - RNA, 1563 nt, Artificial Sequence
  derived and/or modified CDS sequence (opt4) from Nipah henipavirus__AEZ01388__F(27-546) (FdelSS)
auccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 705 - RNA, 1563 nt, Artificial Sequence
  derived and/or modified CDS sequence (opt4) from Nipah henipavirus__AAY43915__F(27-546) (FdelSS)
auccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguacagcagcgaccugcuguucguguucggccccaaccugcaggaccccgugagcaacagcaugaccauccaggccaucagccaggccuucggcggcaacuacgagacccugcugagaacccugggcuacgccaccgagggcuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 706 - RNA, 1563 nt, Artificial Sequence
  derived and/or modified CDS sequence (opt4) from Nipah henipavirus__CAF25496__F(27-546) (FdelSS)
auccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaucgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 707 - RNA, 1563 nt, Artificial Sequence
  derived and/or modified CDS sequence (opt4) from Nipah henipavirus__AAM13405__F(27-546) (FdelSS)
auccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaccaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 708 - RNA, 1563 nt, Artificial Sequence
  derived and/or modified CDS sequence (opt4) from Nipah henipavirus__CBM41033__F(27-546) (FdelSS)
auccugcacuacgagaagcugagcaagaucggccuggugaagggcgugaccagaaaguacaagaucaagagcaacccccugaccaaggacaucgugaucaagaugaucgccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaagagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 709 - RNA, 1563 nt, Artificial Sequence; identical to SEQ ID NO: 704
  derived and/or modified CDS sequence (opt4) from Nipah henipavirus__AEZ01396__F(27-546) (FdelSS)

SEQ ID NO: 710 - RNA, 1563 nt, Artificial Sequence
  derived and/or modified CDS sequence (opt4) from Hendra henipavirus__NP_047111__F(27-546) (FdelSS)
auccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucgccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 711 - RNA, 1563 nt, Artificial Sequence
  derived and/or modified CDS sequence (opt4) from Hendra henipavirus__AEB21233__F(27-546) (FdelSS)
auccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 712 - RNA, 1566 nt, Artificial Sequence
  derived and/or modified CDS sequence (opt4) from Hendra henipavirus__AEQ38114__F(26-546) (FdelSS)
ggcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucaucaucguggagaagaagagaggcaacuacagcagacuggacgacagacaggugagacccgugagcaacggcgaccuguacuacaucggcaccuga

SEQ ID NO: 713 - RNA, 1563 nt, Artificial Sequence
  derived and/or modified CDS sequence (opt4) from Hendra henipavirus__AAB39505__F(27-546) (FdelSS)
auccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugcugaucugcagcugcuucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcagagagcagacccugcugaugaucgacaacaccaccugcaccaccguggugcugggcaacaucaucaucagccugcccaaguaccugggcagcaucaagcugcaggugcugagagcccugcugcugggccaccagagcauccagaccaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 714 - RNA, 1599 nt, Artificial Sequence
  derived and/or modified CDS sequence (opt4) from Nipah henipavirus__AAK50554__G(70-602) (solG)
cagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaaggugguguucaucgagaucagcgaccagagacugagcaucggcagccccagcaagaucuacgacagccugggccagcccguguucuaccaggccagcuucagcugggacaccaugaucaaguucggcgacgugcugaccgugaacccccugguggugaacuggagaaacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 715 - RNA, 1599 nt, Artificial Sequence
  derived and/or modified CDS sequence (opt4) from Nipah henipavirus__AEZ01389__G(70-602) (solG)
cagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccauccugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaaguacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 716 - RNA, 1599 nt, Artificial Sequence
  derived and/or modified CDS sequence (opt4) from Nipah henipavirus__ACT32615__G(70-602) (solG)
cagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccgugcugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaaguacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 717 - RNA, 1599 nt, Artificial Sequence
  derived and/or modified CDS sequence (opt4) from Nipah henipavirus__CAF25497__G(70-602) (solG)
cagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacgugugggccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaaggugguguucaucgagaucagcgaccagagacugagcaucggcagccccagcaagaucuacgacagccugggccagcccguguucuaccaggccagcuucagcugggacaccaugaucaaguucggcgacgugcugaccgugaacccccugguggugaacuggagaaacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 718 - RNA, 1599 nt, Artificial Sequence
  derived and/or modified CDS sequence (opt4) from Nipah henipavirus__CBM41034__G(70-602) (solG)
cagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccgacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaagaucguguucaucgagaucagcgaccagagacugagcaucggcagccccagcaagguguacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 719 - RNA, 1599 nt, Artificial Sequence
  derived and/or modified CDS sequence (opt4) from Nipah henipavirus__AAX51853__G(70-602) (solG)
cagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagaagaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacgacggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacgugcugagaagcggccugcugaaguacaaccugagcgacggcgagaaccccaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugagcuggagagacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 720 - RNA, 1599 nt, Artificial Sequence
  derived and/or modified CDS sequence (opt4) from Nipah henipavirus__AEZ01397__G(70-602) (solG)
cagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccauccugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaccuacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 721 - RNA, 1605 nt, Artificial Sequence
  derived and/or modified CDS sequence (opt4) from Hendra henipavirus__NP_047112__G(70-604) (solG)
cagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 722 - RNA, 1605 nt, Artificial Sequence
  derived and/or modified CDS sequence (opt4) from Hendra henipavirus__AEB21225__G(70-604) (solG)
cagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucacccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 723 - RNA, 1605 nt, Artificial Sequence
  derived and/or modified CDS sequence (opt4) from Hendra henipavirus__AEB21216__G(70-604) (solG)
cagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaacaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 724 - RNA, 1605 nt, Artificial Sequence
  derived and/or modified CDS sequence (opt4) from Hendra henipavirus__AEB21206__G(70-604) (solG)
cagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcaacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacaucgacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 725 - RNA, 1605 nt, Artificial Sequence
  derived and/or modified CDS sequence (opt4) from Hendra henipavirus__AEQ38052__G(70-604) (solG)
cagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucaccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 726 - RNA, 1605 nt, Artificial Sequence
  derived and/or modified CDS sequence (opt4) from Hendra henipavirus__AEQ38115__G(70-604) (solG)
cagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacaacggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 727 - RNA, 1605 nt, Artificial Sequence
  derived and/or modified CDS sequence (opt4) from Hendra henipavirus__AEQ38108__G(70-604) (solG)
cagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucaccaucaccaagguggagagaggcaaguacgacaaggugaugcccuacggccccagcggcaucaagcagggcaacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 728 - RNA, 1605 nt, Artificial Sequence
  derived and/or modified CDS sequence (opt4) from Hendra henipavirus__AAV80426__G(70-604) (solG)
cagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagugcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcagcuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 729 - RNA, 1563 nt, Artificial Sequence
  derived and/or modified CDS sequence (opt5) from Nipah henipavirus__AAK50553__F(27-546) (FdelSS)
auccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgaccgaggacuuugaugaccuccuggagagcgauucuauuacaggacagaucauuuacgucgaccuguccagcuauuacaucauugugcgcguuuauuucccuauccucaccgaaauccaacaggccuacauucaggagcugcuucccguguccuuuaacaaugacaacucugaauggaucagcauugucccuaauuucauccuggugagaaacacccucauuuccaauaucgagauuggcuuuugucugaucacaaagcggagcguuaucugcaaccaggauuaugcuacgccgaugaccaauaacaugcgcgaaugucuuacagggucuaccgagaaaugccccagagagcugguggucuccagccacgugccucgguucgcccucucuaauggaguccuguuugcuaacuguauuagcgugacaugccaaugucagaccacgggccgcgccaucucccagucuggcgaacaaacacugcucaugauugacaauacaaccugccccaccgccguucuggggaacgugaucauuagccuuggaaaguaccugggcuccgucaauuacaacagcgaggggaucgcuaucggaccucccguguucaccgauaagguugacauuucuucccagaucagcucuaugaaucagucccuccagcaaagcaaagauuauauuaaggaagcgcagagacugcuggacacagugaacccgucccuuaucucuaugcucagcaugauuauccuguacguccuguccaucgccucucucugcauuggccugaucacguuuauuagcuucaucauuguggagaaaaagcggaacaccuauucccgccuugaagauagacgggugcgcccuacaagcucuggggaccuguacuauaucggaaccuga

SEQ ID NO: 730 - RNA, 1563 nt, Artificial Sequence
  derived and/or modified CDS sequence (opt5) from Nipah henipavirus__AEZ01388__F(27-546) (FdelSS)
auucuccacuacgaaaaacugagcaagaucgggcuuguuaaaggaaucacccggaaguauaaaauuaaguccaacccccugacaaaggacaucgugauuaaaaugaucccuaaugugucuaacaugagccaguguacgggcuccgucauggagaauuacaagacccgccucaacgggauucugacaccgaucaaaggagcucuggaaauuuauaagaauaacacccaugaucucgugggcgacguuagacuggccggggugaucauggcgggagucgcuaucggcauugccacagccgcucaaaucaccgccggcguggcucuuuacgaggccaugaaaaaugcggauaacauuaauaagcugaagucuagcaucgaauccacaaacgaggccguugugaaacuccaggagaccgcugaaaagacggucuaugugcugaccgcccuucaggacuacauuaauacaaaccuggugcccaccaucgauaaaaucagcugcaagcagacagagcucucucuggaccuggcucucuccaaauaccugagcgaucuucuguucgucuuugggccuaaucuccaagaccccguuucuaacuccaugaccauucaggccaucagccaggcguucggaggcaacuaugaaacgcugcuucggacacugggguacgccaccgaggauuuugacgaucuccuggagucugacuccauuacaggacagaucauuuauguggaucugagcggcuacuauaucaucgugcgcgucuacuucccuauucucaccgaaauccaacaggcuuauauucaggagcugcuucccguguccuuuaauaacgacaauucugaauggaucagcauuguuccuaacuucauccuggugagaaauacccucauuuccaacaucgagaucggguuuugucugauuacaaagcggagcgucaucugcaaucaggacuacgccacgccgaugaccaacaauaugcgcgaaugucuuacaggaucuaccgagaaaugccccagagagcuggugguuuccagccacgugccucgguucgcucucucuaacggcguccuguuugccaauuguauuagcgugacaugccaaugucagaccacgggccgcgccaucucccagucuggggaacaaacacugcucaugauugauaacacaaccugccccaccgcuguccugggaaaugugaucaucagccuuggcaaguaccugggguccguuaacuauaauagcgagggaauugcgaucggcccucccguguucaccgacaaggucgauauuucuucccagaucagcucuaugaaccagucccuccagcaaagcaaagacuacauuaaggaagcccagagacugcuggauacagugaacccgucccuuaucucuaugcucagcaugaucauucuguauguucuguccaucgcuucucucuguauugggcugaucacguuuauuagcuucaucaucguggagaaaaagcggaauaccuacucccgccuugaagacagacggguccgcccuacaagcucuggagaucuguauuacauuggcaccuga

SEQ ID NO: 731 - RNA, 1563 nt, Artificial Sequence
  derived and/or modified CDS sequence (opt5) from Nipah henipavirus__AAY43915__F(27-546) (FdelSS)
auccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauacagcucugaucugcuuuucgucuuugggccuaaucugcaagaccccguuuccaacagcaugaccauccaggccauuucucaggcguucggaggcaacuaugaaacgcuccugcggacacuuggguacgccaccgagggauuugaugaccugcucgaguccgauagcaucacaggccagauuaucuauguggaccuguccggguacuauauuaucgugcgcgucuacuucccuauccugaccgaaauucaacaggcuuauauccaggagcuccugcccgugucuuuuaauaacgauaauagcgaauggauuuccaucguuccuaacuucauucuugugagaaauacccugaucagcaacauugagaucggauuuugucucaucacaaagcggucugucauuugcaaucaggacuacgccacgccgaugaccaacaauaugcgcgaaugucugacaggcuccaccgagaaaugccccagagagcuugugguuagcucucacgugccucgguucgcucugagcaacggcguccucuuugccaauuguaucuccgugacaugccaaugucagaccacggggcgcgccauuucucagagcggagaacaaacacugcugaugaucgacaacacaaccugccccaccgcuguccucggcaaugugauuaucucccuggggaaguaccuuggaagcguuaacuauaauucugagggcaucgcgauugggccucccguguucaccgauaaggucgacaucuccagccagauuucuuccaugaaccagagccugcagcaauccaaagauuacaucaaggaagcccagagacuccuggacacagugaacccgucucugauuagcaugcuuuccaugaucauccucuauguucugucuauugcuagccuguguaucggacucauuacguuuaucuccuucauuaucguggagaaaaagcggaauaccuacagccgccuggaagauagacggguccgcccuacaucuuccggcgaccuuuauuacaucggcaccuga

SEQ ID NO: 732 - RNA, 1563 nt, Artificial Sequence
  derived and/or modified CDS sequence (opt5) from Nipah henipavirus__CAF25496__F(27-546) (FdelSS)
auccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgauugaggacuuugaugaccuccuggagagcgauucuaucaccggacagauuaucuacgucgaccuguccagcuauuacauuaucgugcgcguuuauuucccuauccucacagaaauucaacaggccuacauccaggagcugcuucccguguccuuuaacaaugacaacucugaauggauuagcaucgucccuaauuucauucuggugagaaacacccucaucuccaauauugagaucggcuuuugucugaucaccaagcggagcguuauuugcaaccaggauuaugcuacaccgaugacgaauaacaugcgcgaaugucuuaccgggucuacagagaaaugccccagagagcugguggucuccagccacgugccucgguucgcccucucuaauggaguccuguuugcuaacuguaucagcgugaccugccaaugucagacaaccggccgcgccauuucccagucuggcgaacaaacgcugcucaugaucgacaauacaaccugccccaccgccguucuggggaacgugauuaucagccuuggaaaguaccugggcuccgucaauuacaacagcgaggggaucgcuauuggaccucccguguucacagauaagguugacaucucuucccagauuagcucuaugaaucagucccuccagcaaagcaaagauuauaucaaggaagcgcagagacugcuggacaccgugaacccgucccuuauuucuaugcucagcaugaucauccuguacguccuguccauugccucucucugcaucggccugauuacauuuaucagcuucauuaucguggagaaaaagcggaacacguauucccgccuugaagauagacgggugcgcccuaccagcucuggggaccuguacuauaucggaacauga

SEQ ID NO: 733 - RNA, 1563 nt, Artificial Sequence
  derived and/or modified CDS sequence (opt5) from Nipah henipavirus__AAM13405__F(27-546) (FdelSS)
auccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgaccgaggacuuugaugaccuccuggagagcgauucuauuacaggacagaucauuuacgucgaccuguccagcuauuacaucauugugcgcguuuauuucccuauccucaccgaaauccaacaggccuacauucaggagcugcuucccguguccuuuaacaaugacaacucugaauggaucagcauugucccuaauuucauccuggugagaaacacccucauuuccaauaucgagauuggcuuuugucugaucacaaagcggagcguuaucugcaaccaggauuaugcuacgccgaccacaaauaacaugcgcgaaugucuuaccgggucuacagagaaaugccccagagagcugguggucuccagccacgugccucgguucgcccucucuaauggaguccuguuugcuaacuguauuagcgugaccugccaaugucagacgacaggccgcgccaucucccagucuggcgaacaaacccugcucaugauugacaauaccacaugccccaccgccguucuggggaacgugaucauuagccuuggaaaguaccugggcuccgucaauuacaacagcgaggggaucgcuaucggaccucccguguucacagauaagguugacauuucuucccagaucagcucuaugaaucagucccuccagcaaagcaaagauuauauuaaggaagcgcagagacugcuggacacggugaacccgucccuuaucucuaugcucagcaugauuauccuguacguccuguccaucgccucucucugcauuggccugaucaccuuuauuagcuucaucauuguggagaaaaagcggaacacauauucccgccuugaagauagacgggugcgcccuaccagcucuggggaccuguacuauaucggaacauga

SEQ ID NO: 734 - RNA, 1563 nt, Artificial Sequence
  derived and/or modified CDS sequence (opt5) from Nipah henipavirus__CBM41033__F(27-546) (FdelSS)
auccuccacuaugaaaaacugagcaagauugggcuugugaaaggagugacccggaaguacaaaaucaaguccaauccccugacaaaggauaucgucauuaaaaugaucgccaacgugucuaauaugagccagugcacgggcuccguuauggagaacuauaagacccgccucaaugggauucugacaccuaucaaaggagcucuggaaauuuacaagaacaauacccaugaccucgugggcgaugucagacuggccggggugaucauggcgggaguugcuauuggcaucgccacagccgcucaaaucaccgccggcguggcucuuuaugaggccaugaaaaacgcggacaauauuaacaagcugaagucuagcaucgaauccacaaaugaggccgucgugaaacuccaggagaccgcugaaaagacgguguacguccugaccgcccuucaggauuauauuaacacaaaucugguuccgaccaucgacaaaauuagcuguaagcagacagagcucucucuggaucuggcucucuccaaauaccugagcgaccuucuguucguguuugggcccaaccuccaagauccugugucuaauuccaugaccauccaggccaucagccaggcguucggaggcaacuacgaaacgcugcuucggacacugggguaugccaccgaggacuuugaugaccuccuggagucugauuccauuacaggacagaucauuuacgucgaccugagcuccuauuacaucauugugcgcguuuauuuccccauccucaccgaaauccaacaggcuuacauucaggagcugcuuccugugucuuuuaacaaugacaacagcgaauggaucuccauuguccccaauuucauccuggugagaaacacccucauuagcaauaucgagauuggcuuuugccugaucacaaagcggucuguuaucuguaaccaggauuaugccacgccuaugaccaauaacaugcgcgaaugccuuacaggguccaccgagaaauguccgagagagcugguggucagcucucacgugccccgguucgcucucagcaauggaguccuguuugccaacugcauuuccgugacaugucaaugccagaccacgggccgcgccaucucucagagcggcgaacaaacacugcucaugauugacaauaccaccuguccuacagcuguucuggggaacgugaucauuucccuuggaaaguaccugggcagcgucaauuacaacucugaggggaucgcgaucggacccccuguguucaccgauaagguugacauuuccagccagaaaucuuccaugaaucagagccuccagcaauccaaggauuauaucaaagaagcccagagacugcuggacacagugaaccccucucuuauuagcaugcucuccaugaucauucuguacguccugucuaucgcuagccucugcaucggccugauuacguuuaucuccuucauuaucguggagaagaaacggaacaccuauagccgccuugaagauagacgggugcgcccgacaucuuccggggaccuguacuauauuggaaccuga

SEQ ID NO: 735 - RNA, 1563 nt, Artificial Sequence
  derived and/or modified CDS sequence (opt5) from Nipah henipavirus__AEZ01396__F(27-546) (FdelSS)
auccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauaccugagcgaucuucuguucgucuuugggccuaaucuccaagaccccguuucuaacuccaugaccauccaggccauuagccaggcguucggaggcaacuaugaaacgcugcuucggacacugggguacgccaccgaggauuuugacgaucuccuggagucugacuccaucacaggacagauuaucuauguggaucugagcggcuacuauauuaucgugcgcgucuacuucccuauccucaccgaaauucaacaggcuuauauccaggagcugcuucccguguccuuuaauaacgacaauucugaauggauuagcaucguuccuaacuucauucuggugagaaauacccucaucuccaacauugagaucggguuuugucugaucacaaagcggagcgucauuugcaaucaggacuacgccacgccgaugaccaacaauaugcgcgaaugucuuacaggaucuaccgagaaaugccccagagagcuggugguuuccagccacgugccucgguucgcucucucuaacggcguccuguuugccaauuguaucagcgugacaugccaaugucagaccacgggccgcgccauuucccagucuggggaacaaacacugcucaugaucgauaacacaaccugccccaccgcuguccugggaaaugugauuaucagccuuggcaaguaccugggguccguuaacuauaauagcgagggaaucgcgauuggcccucccguguucaccgacaaggucgauaucucuucccagauuagcucuaugaaccagucccuccagcaaagcaaagacuacaucaaggaagcccagagacugcuggauacagugaacccgucccuuauuucuaugcucagcaugaucauccuguauguucuguccauugcuucucucuguaucgggcugauuacguuuaucagcuucauuaucguggagaaaaagcggaauaccuacucccgccuugaagacagacggguccgcccuacaagcucuggagaucuguauuacaucggcaccuga

SEQ ID NO: 736 - RNA, 1563 nt, Artificial Sequence
  derived and/or modified CDS sequence (opt5) from Hendra henipavirus__NP_047111__F(27-546) (FdelSS)
auccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaaaaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucgccgggcaaauugucuauguggaucugucuuccuacuauaucauuguucggguguacuucccuauccuuaccgagauucagcaggcuuauguccaggaacugcuccccgugagcuuuaacaacgacaauuccgaguggaucucuaucguuccuaacuucgugcugauucgcaauacccuuaucagcaacauugaagucaaguacugccugaucacaaagaaguccgugauuuguaaucaagacuaugccacgccgaugaccgccagcgucagagagugccucacaggaucuaccgauaaguguccccgggagcuggugguuuccagccacgugccucgcuuugcucugucuggcggcguccucuucgcgaacugcaucagcgugacaugucagugccagaccacggggagagccauuucccaaucuggagaacagacacugcuuaugaucgacaauaccaccuguacaaccguugugcugggcaacaucauuaucagccucgggaaauaccugggauccauuaauuacaacagcgagucuaucgcugucgggcccccuguguauacagauaagguggacauuuccagccagaucucuuccaugaaucagagccugcaacaguccaaagauuacaucaaggaagcccagaaaauucuugacacgguuaaccccucucucaucagcaugcuguccaugauuauccuguauguccucucuauugccgcucugugcaucggccuuaucaccuuuauuagcuucgugaucguggagaagaagcggggaaauuacucccgccuggaugacagacagguccggccggugagcaacggcgaucucuauuacauuggcacauga

SEQ ID NO: 737 - RNA, 1563 nt, Artificial Sequence
  derived and/or modified CDS sequence (opt5) from Hendra henipavirus__AEB21233__F(27-546) (FdelSS)
auccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucaccgggcaaauugucuauguggaucugucuuccuacuauaucauuguucggguguacuucccuauccuuaccgagauucagcaggccuauguccaggaacugcuccccgugagcuuuaacaacgacaauuccgaguggaucucuaucguuccuaacuucgugcugauucgcaauacacuuaucagcaacauugaagucaaguacugccugaucacgaaaaaguccgugauuuguaaucaagacuaugcuaccccgaugacagccagcgucagagagugccucaccggaucuacagauaaguguccccgggagcuggugguuuccagccacgugccucgcuuugcccugucuggcggcguccucuucgcuaacugcaucagcgugaccugucagugccagacgacagggagagcgauuucccaaucuggagaacagacccugcuuaugaucgacaauaccacauguaccacaguugugcugggcaacaucauuaucagccucgggaaauaccugggauccauuaauuacaacagcgagucuaucgccgucgggcccccuguguauacggauaagguggacauuuccagccagaucucuuccaugaaucagagccugcaacaguccaaagauuacaucaaggaagcucagaaaauucuugacaccguuaaccccucucucaucagcaugcuguccaugauuauccuguauguccucucuauugccgcccugugcaucggccuuaucacauuuauuagcuucgugaucguggagaagaagcggggaaauuacucccgccuggaugacagacagguccggccggugagcaacggcgaucucuauuacauuggcaccuga

SEQ ID NO: 738 - RNA, 1566 nt, Artificial Sequence
  derived and/or modified CDS sequence (opt5) from Hendra henipavirus__AEQ38114__F(26-546) (FdelSS)
ggaauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucaccgggcaaauugucuauguggaucugucuuccuacuauaucauuguucggguguacuucccuauccuuaccgagauucagcaggccuauguccaggaacugcuccccgugagcuuuaacaacgacaauuccgaguggaucucuaucguuccuaacuucgugcugauucgcaauacacuuaucagcaacauugaagucaaguacugccugaucacgaaaaaguccgugauuuguaaucaagacuaugcuaccccgaugacagccagcgucagagagugccucaccggaucuacagauaaguguccccgggagcuggugguuuccagccacgugccucgcuuugcccugucuggcggcguccucuucgcuaacugcaucagcgugaccugucagugccagacgacagggagagcgauuucccaaucuggagaacagacccugcuuaugaucgacaauaccacauguaccacaguugugcugggcaacaucauuaucagccucgggaaauaccugggauccauuaauuacaacagcgagucuaucgccgucgggcccccuguguauacggauaagguggacauuuccagccagaucucuuccaugaaucagagccugcaacaguccaaagauuacaucaaggaagcucagaaaauucuugacaccguuaaccccucucucaucagcaugcuguccaugauuauccuguauguccucucuauugccgcccugugcaucggccuuaucacauuuauuagcuucaucauuguggagaagaagcggggaaauuacucccgccuggaugacagacaggugcggccggucagcaacggcgaucucuauuacaucggcaccuga

SEQ ID NO: 739 - RNA, 1563 nt, Artificial Sequence
  derived and/or modified CDS sequence (opt5) from Hendra henipavirus__AAB39505__F(27-546) (FdelSS)
auccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugcucauuugcucuuguuucggcccuaaucugcaggaucccguguccaacagcaugacgauccaggcgaucucucaggccuuugggggaaauuacgagacacuucugagaacccucggcuacgcuacagaggacuucgaugaccugcuggaauccgauagcauuaccgggcaaaucguguaugucgaccucucuuccuacuauauuaucgugcggguuuacuuuccuauucugaccgagauccagcaggccuaugugcaggaacuucugcccgucagcuucaacaacgauaauuccgaguggaucucuauugugccuaacuuuguucucauccgcaauacacugauuagcaacaucgaagugaaguacugccuuauuacgaaaaaguccgucaucuguaaucaagacuaugcuaccccgaugacagccagcgugagagagugccugaccggaucuacagacaaguguccccgggagcucgucguguccagccacguuccucgcuucgcccugucuggcggcgugcuguuugcuaacugcauuagcgucaccugucagugccagacgacagggagagcgaucucccaaucucgggaacagacccuccugaugaucgauaauaccacaugcaccacagugguucuuggaaacauuaucauuagccugcccaaauaccucggcuccaucaagcugcaagugcugcgcgcccuucuccuggggcaucagagcauucagacgaaagucgacaucucuucccagaucagcucuaugaaucagucccugcagcaaagcaaggauuacauuaaagaggcucagaagauccucgacaccgugaacccuucccugauuucuaugcuuagcaugaucauucuguaugugcucuccaucgccgcccuguguaucggacugauuacauucaucucuuuuguuauugucgaaaagaaaagaggcaauuacagccggcuugaugaccgccaggugagacccguguccaacggggaucucuauuacaucggaaccuga

SEQ ID NO: 740 - RNA, 1599 nt, Artificial Sequence
  derived and/or modified CDS sequence (opt5) from Nipah henipavirus__AAK50554__G(70-602) (solG)
cagaauuacacacggagcaccgauaaccaagcggucauuaaggacgcucuccaggggauccagcagcaaauuaaaggacuggccgauaagaucggcacagaaaucgggccgaaagugucccuuauugacaccucuagcacaaucaccauucccgccaauaucggacugcucggcuccaagauuagccagucuacggcuuccaucaacgagaauguuaacgaaaagugcaaauucacccugccuccccugaagauccacgaguguaauauuagcugcccuaacccccucccuuuucgcgaguauagaccgcagacagaaggcgugucuaaucuggucgggcuucccaacaauaucugucugcagaaaaccuccaaccaaauucucaagccuaaacugaucagcuacacacuucccgugguuggacagucugggaccugcauuacggauccucugcucgccauggacgagggcuauuucgcuuacucccaucuggaacggaucggaagcuguucccgcggcgugucuaagcagagaaucauuggggucggagaggugcuggaucggggcgacgaggugcccagccucuuuaugacaaacgucuggaccccgccuaaucccaacacaguuuaucacugcuccgccguguacaauaacgaguucuacuaugugcugugugcggucagcaccgugggcgauccuauccuuaauucuaccuacugguccgggagccugaugaugacacgccucgccguuaaacccaagucuaacggaggcggguauaaucagcaucaacuggcucuuagaagcauugaaaagggacgguacgacaaagugaugcccuauggcccuuccgggaucaagcagggagauacgcuguacuuuccggccgucggcuuccucgugcgcaccgaauuuaaauauaacgacucuaauugccccauuacaaagugucaguacagcaaaccugagaacugcagacuguccaugggcauccggcccaauagccacuacauucugcgcucugggcuccugaaguauaaccuuuccgacggagaaaauccuaagguuguguucaucgagaucagcgaucaaagacugucuauuggcucccccagcaaaaucuacgacucccucgggcagccggucuuuuaucaggcuucuuucagcugggauaccaugauuaaguuuggagacgugcugacagucaacccucuugugguuaauuggcggaacaacaccgugaucucccgccccggccagucucaauguccuagauucaauacgugccccgagauuugcugggaaggggucuacaacgaugccuuccugaucgaccggaucaauuggauuagcgcgggcguguuucucgauuccaaccagacagccgagaauccuguuuucaccguguuuaaagacaacgaaauccuguauagagcucagcuggccagcgaggauaccaaugcucagaagacaauuaccaacuguuuccuccugaaaaauaagaucuggugcauuucucuugucgaaaucuacgacacaggagauaacgugauccgccccaagcuguuugccgugaaaauuccggagcaauguacguga

SEQ ID NO: 741 - RNA, 1599 nt, Artificial Sequence
  derived and/or modified CDS sequence (opt5) from Nipah henipavirus__AEZ01389__G(70-602) (solG)
cagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccauucuuaauucuaccuacuggagcggcucccugaugaugaccagacucgccguuaagccuaaaaacaauggggaaucuuauaaccagcaucaauuugcucugcggaauaucgaaaagggaaaauacgacaaggugaugcccuauggccccagcgggauuaaacagggagauacacuuuacuucccugccgucggcuuucuggugcgcacggaguucaaguauaacgacuccaauugcccgaucgcugaaugucaguacagcaagcccgagaacugcagacucucuauggggauucggccuaauucccacuacauccugcgcagcggacugcucaaauauaaccugucugacgaggaaaauuccaagauuguuuuuaucgagaucagcgaucaaagacuuuccauuggcucucccagcaaaaucuacgacucccugggccagccuguguucuaucaggccucuuuuagcugggauaccaugauuaaguucggggacguccagacagugaacccccucgucgugaacuggcgggauaauaccguuaucucccgcccgggacaaagccaguguccuagauucaacaaaugccccgaagugugcugggagggcgucuacaaugacgcguuucugauugaucggaucaacuggaucucugccgggguguuccuugacuccaaucagacagcugaaaacccuguuuuuaccguguucaaggauaaugagguccuguaucgcgcccagcucgcuagcgaggacacgaacgcccaaaagacaauuaccaauuguuuucugcugaaaaacaagaucuggugcauuucucucguggaaaucuacgauaccggagacaaugugauuagacccaaacuguucgccguuaagaucccugagcaguguacauga

SEQ ID NO: 742 - RNA, 1599 nt, Artificial Sequence
  derived and/or modified CDS sequence (opt5) from Nipah henipavirus__ACT32615__G(70-602) (solG)
cagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccguucuuaauucuaccuacuggagcggcucccugaugaugaccagacucgccgugaagccuaaaaacaauggggaaucuuauaaccagcaucaauuugcucugcggaauauugaaaagggaaaauacgacaaggucaugcccuauggccccagcgggaucaaacagggagauacacuuuacuucccugccgugggcuuucugguucgcacggaguucaaguauaacgacuccaauugcccgauugcugaaugucaguacagcaagcccgagaacugcagacucucuauggggauccggccuaauucccacuacauucugcgcagcggacugcucaaauauaaccugucugacgaggaaaauuccaagaucguguuuauugagaucagcgaucaaagacuuuccaucggcucucccagcaaaauuuacgacucccugggccagccugucuucuaucaggccucuuuuagcugggauaccaugaucaaguucggggacgugcagacagucaacccccucgugguuaacuggcgggauaauaccgugauuucccgcccgggacaaagccaguguccuagauucaacaaaugccccgaagucugcugggagggcguguacaaugacgcguuucugaucgaucggauuaacuggaucucugccgggguuuuccuugacuccaaucagacagcugaaaacccuguguuuaccgucuucaaggauaaugaggugcuguaucgcgcccagcucgcuagcgaggacacgaacgcccaaaagacaaucaccaauuguuuucugcugaaaaacaagauuuggugcaucucucucguggaaauuuacgauaccggagacaauguuaucagacccaaacuguucgccgucaagauuccugagcaguguacauga

SEQ ID NO: 743 - RNA, 1599 nt, Artificial Sequence
  derived and/or modified CDS sequence (opt5) from Nipah henipavirus__CAF25497__G(70-602) (solG)
cagaacuacacacggagcaccgauaaucaagcggucaucaaggacgcucuccaggggauucagcagcaaaucaaaggacuggccgauaagauuggcacagaaaucgggccgaaagugucccuuaucgacaccucuagcacaauuaccauccccgccaacauuggacugcucggcuccaagaucagccagucuacggcuuccauuaaugagaacguuaaugaaaagugcaaauucacccugccuccccugaagauccacgaguguaacaucagcugcccuaauccccucccuuuucgcgaguauagaccgcagacagaaggcgugucuaaccuggucgggcuucccaauaacauuugucugcagaaaaccuccaaccaaauccucaagccuaaacugauuagcuacacacuucccgugguuggacagucugggaccugcaucacggauccucugcucgccauggacgagggcuauuucgcuuacucccaucuggaacggauuggaagcuguucccgcggcgugucuaagcagagaaucaucggggucggagaggugcuggaucggggcgacgaggugcccagccucuuuaugacaaaugucugggccccgccuaaccccaauaccguuuaucacugcuccgcgguguacaacaaugaguucuacuaugugcugugugccgucagcacagugggcgauccuauucuuaacucuaccuacugguccgggagccugaugaugacccgccucgcuguuaaacccaagucuaauggaggcggguauaaccagcaucaacuggcccuuagaagcaucgaaaagggacgguacgacaaagugaugcccuauggcccuuccgggauuaagcagggagauacacuguacuuuccggcugucggcuuccucgugcgcacggaauuuaaauauaaugacucuaacugccccaucaccaagugucaguacagcaaaccugagaauugcagacuguccaugggcauucggcccaacagccacuacauccugcgcucugggcuccugaaguauaaucuuuccgacggagaaaacccuaagguuguguucauugagaucagcgaucaaagacugucuaucggcucccccagcaaaauuuacgacucccucgggcagccggucuuuuaucaggccucuuucagcugggauacaaugaucaaguuuggagacgugcugaccgucaauccucuugugguuaacuggcggaacaauacagugauuucccgccccggccagucucaauguccuagauucaauaccugccccgagaucugcugggaaggggucuacaacgaugcguuccugauugaccggaucaacuggaucagcgccggcguguuucucgauuccaaucagacggcugagaacccuguuuucacaguguuuaaagacaaugaaauucuguauagagcccagcuggcuagcgaggauaccaacgcccagaagaccaucacaaauuguuuccuccugaaaaacaagauuuggugcaucucucuugucgaaauuuacgacaccggagauaaugugauccgccccaagcuguuugccgugaaaaucccggagcaauguacauga

SEQ ID NO: 744 - RNA, 1599 nt, Artificial Sequence
  derived and/or modified CDS sequence (opt5) from Nipah henipavirus__CBM41034__G(70-602) (solG)
cagaacuacacacggagcaccgauaaucaagcggucaucaaggacgcucuccaggggauucagcagcaaaucaaaggacuggccgauaagauuggcacagaaaucgggccgaaagugucccuuaucgacaccucuagcacaauuaccauccccgccaacauuggacugcucggcuccaagaucagccagucuacggcuuccauuaaugagaacguuaaugaaaagugcaaauucacccugccuccccugaagauccacgaguguaacaucagcugcccuaauccccucccuuuucgcgaguauagaccgcagacagaaggcgugucuaaccuggucgggcuucccgauaauauuugucugcagaaaaccuccaaccaaauccucaagccuaaacugauuagcuacacacuucccgugguuggacagucugggaccugcaucacggacccucugcucgccauggaugagggcuauuucgcuuacucccaucuggaacggauuggaagcuguucccgcggcgugucuaagcagagaaucaucggggucggagaggugcuggaccggggcgaugaggugcccagccucuuuaugacaaacgucuggaccccgccuaaucccaacacaguuuaucacugcuccgccguguacaauaacgaguucuacuaugugcugugugcggucagcaccgugggcgacccuauucuuaauucuaccuacugguccgggagccugaugaugacacgccucgccguuaaacccaagucuaacggaggcggguauaaucagcaucaacuggcucuuagaagcaucgaaaagggacgguacgauaaagugaugcccuauggcccuuccgggauuaagcagggagacacgcuguacuuuccggccgucggcuuccucgugcgcaccgaauuuaaauauaacgacucuaauugccccaucacaaagugucaguacagcaaaccugagaacugcagacuguccaugggcauucggcccaauagccacuacauccugcgcucugggcuccugaaguauaaccuuuccgauggagaaaauccuaagauuguuuucaucgagaucagcgaccaaagacugucuauuggcucccccagcaaaguguacgauucccucgggcagccggucuuuuaucaggcuucuuucagcugggacaccaugaucaaguuuggagaugugcagacagucaacccucuggugguuaauuggcgggacaacaccgugauuucccgccccggccaaucucaguguccuagauucaacacgugccccgagaucugcugggaaggggucuacaaugaugccuuccuuauugaccggaucaacuggaucagcgcgggcguguuucuggauuccaaucagacagccgagaacccuguuuucaccguguuuaaagacaaugaaauucucuauagagcucagcuggccagcgaggauaccaacgcucaaaagacaaucaccaauuguuuccugcucaaaaacaagauuuggugcaucucucuggucgaaauuuacgacacaggagacaaugugauccgccccaaacuuuuugccgugaagaucccggagcaguguacguga

SEQ ID NO: 745 - RNA, 1599 nt, Artificial Sequence
  derived and/or modified CDS sequence (opt5) from Nipah henipavirus__AAX51853__G(70-602) (solG)
cagaacuacacacgguccaccgauaaucaagcggugaucaaggacgcucuccaggggauucagcagcaaaucaaaggacuggccgauaagaucggcacagaaauugggccgaaagucucucuuaucgacaccagcuccacaauuaccauccccgccaacauuggacugcucggcagcaagaucucucaguccacggcuagcaucaaugagaacgugaaugaaaagugcaaauucacccugccuccccugaagauucacgaguguaacaucucuugcccuaauccccucccuuuucgcgaguauagaccgcagacagaaggcguuuccaaccugguggggcuucccaauaacauuugucugcagaaaaccagcaaucaaauccucaagccuaaacugauuucuuacacacuucccgucgugggacaguccgggaccugcaucacggauccucugcucgccauggacgagggcuauuucgcuuacagccaucuggaacggaucggauccuguucucgcggcguuagcaagcagaaaauuaucggggugggagagguccuggauagaggcgacgaggugcccucccucuuuaugacaaacguguggaccccgccuaaccccaauacagucuaucacugcagcgccguuuacaacaaugaguucuacuaugugcugugugcggugucuaccgucggcgauccuauucuuaacuccaccuacuggagcgggucucugaugaugacacggcucgccgugaagcccaagagcaaugacggaggcuauaaccagcaucaacuggcccuucgcuccaucgaaaaagggagauacgauaagguuaugcccuauggaccuucuggcauuaaacagggggacacgcuguacuuuccggcugugggauuccucguccggaccgaauuuaaguauaaugacagcaacugccccaucacaaaaugucaguacuccaagccugagaauugccgccugagcaugggcauuagacccaacucucacuacgugcugcgguccggccuccugaaguauaaucuuagcgauggggaaaacccuaaaaucguuuucaucgagauuucugaccaacgccuguccaucggaagccccuccaagauuuacgauucucucggccagccgguguuuuaucaggcuagcuucuccugggacaccaugaucaaauuuggggauguccagacagugaauccucuggucgugucuuggagagacaacaccguuauuagccggcccggacaaucccaguguccucgcuucaauacgugccccgagaucugcugggaaggcguguacaacgaugccuuccuuaucgacagaauuaacuggaucagcgcgggggucuuucuggauucuaaucagacagccgagaacccuguguucaccguuuuuaaggacaaugaaauucucuaucgggcucagcuggccuccgaggauaccaacgcucagaaaacaaucaccaauuguuuccugcucaagaacaagauuuggugcaucagccugguggaaaucuacgacacaggcgacaaugucauuagacccaaacuuuuugccgugaagaucccggagcaauguacguga

SEQ ID NO: 746 - RNA, 1599 nt, Artificial Sequence
  derived and/or modified CDS sequence (opt5) from Nipah henipavirus__AEZ01397__G(70-602) (solG)
cagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccauucuuaauucuaccuacuggagcggcucccugaugaugaccagacucgccguuaagccuaaaaacaauggggaaucuuauaaccagcaucaauuugcucugcggaauaucgaaaagggaaaauacgacaaggugaugcccuauggccccagcgggauuaaacagggagauacacuuuacuucccugccgucggcuuucuggugcgcacggaguucaccuauaacgacuccaauugcccgaucgcugaaugucaguacagcaagcccgagaacugcagacucucuauggggauucggccuaauucccacuacauccugcgcagcggacugcucaaguauaaccugucugacgaggaaaauuccaaaauuguuuuuaucgagaucagcgaucaaagacuuuccauuggcucucccagcaagaucuacgacucccugggccagccuguguucuaucaggccucuuuuagcugggauacaaugauuaaauucggggacguccagaccgugaacccccucgucgugaacuggcgggauaauacaguuaucucccgcccgggacaaagccaguguccuagauucaacaagugccccgaagugugcugggagggcgucuacaaugacgcguuucugauugaucggaucaacuggaucucugccgggguguuccuugacuccaaucagaccgcugaaaacccuguuuuuacgguguucaaagauaaugagguccuguaucgcgcccagcucgcuagcgaggacacaaacgcccaaaagaccauuaccaauuguuuucugcugaagaacaaaaucuggugcauuucucucguggaaaucuacgauacaggagacaaugugauuagacccaagcuguucgccguuaaaaucccugagcaguguaccuga

SEQ ID NO: 747 - RNA, 1605 nt, Artificial Sequence
  derived and/or modified CDS sequence (opt5) from Hendra henipavirus__NP_047112__G(70-604) (solG)
caaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucgcgaucaccaagguggaacgggggaaauacgauaaggugaugccuuauggacccagcggcauuaaacaaggggacacacuguacuuucccgccgucggauuccugccucgcaccgaguuucaguauaaugauuccaacugcccgaucauucacuguaaguacagcaaagcugagaauugcagacucucuaugggcgugaacuccaagagccacuauauccugcggucugggcuucugaaguacaaucucucccugggaggcgacauuauccuucaguucaucgaaauugccgauaaccgccugacgaucggcagccccuccaaaauuuacaauucucucgggcaaccuguguuuuaucaggcuagcuacuccugggacacaaugaucaagcugggagauguugacaccgucgauccccugagagugcaguggcggaacaauucuguuauuagccgcccuggccagucccaaugucccagauucaacgugugcccggaggucugcugggaagggaccuauaaugacgccuuucucaucgaccggcugaacugggugagcgcgggagucuaccuuaacucuaaucagacagccgagaacccuguguucgcuguuuucaaagauaaugaaauccuguaucaggugccccucgccgaggacgauaccaacgcucagaagacaauuacggacuguuuucugcuggagaaugucaucuggugcauuucccuuguggaaaucuacgauaccggcgacagcguuauuagaccuaaacucuucgccgugaagauccccgcccaauguucugaguccuga

SEQ ID NO: 748 - RNA, 1605 nt, Artificial Sequence
  derived and/or modified CDS sequence (opt5) from Hendra henipavirus__AEB21225__G(70-604) (solG)
caaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucgcgaucaccaagguggaacgggggaaauacgauaaggugaugccuuauggacccagcggcauuaaacaaggggacacacuguacuuucccgccgucggauuccugccucgcaccgaguuucaguauaaugauuccaacugcccgaucauucacuguaaguacagcaaagcugagaauugcagacucucuaugggcgugaacuccaagagccacuauauccugcggucugggcuucugaaguacaaucucucccugggaggcgacauuacgcuucaguucaucgaaaucgccgauaaccgccugacaauuggcagccccuccaaaaucuacaauucucucgggcaaccuguguuuuaucaggcuagcuacuccugggacaccaugauuaagcugggagauguugacaccgucgauccccugagagugcaguggcggaacaauucuguuaucagccgcccuggccagucccaaugucccagauucaacgugugcccggaggucugcugggaagggacauauaaugacgccuuucucauugaccggcugaacugggugagcgcgggagucuaccuuaacucuaaucagaccgccgagaacccuguguucgcuguuuucaaagauaaugaaauccuguaucaggugccccucgccgaggacgauacaaacgcucagaagacgaucaccgacuguuuucugcuggagaaugucauuuggugcaucucccuuguggaaauuuacgauacaggcgacagcguuaucagaccuaaacucuucgccgugaagauucccgcccaauguucugaguccuga

SEQ ID NO: 749 - RNA, 1605 nt, Artificial Sequence
  derived and/or modified CDS sequence (opt5) from Hendra henipavirus__AEB21216__G(70-604) (solG)
caaaauuacacgagaaccacagauaaccaggcgcuuaucaaagagucucugcagagcgugcagcaacagauuaaggcucucaccgacaaaaucggcacagaaaucgggccuaaggucucccugauugauaccucuagcacaaucaccauuccggccaauaucggacugcucggcuccaaaauuagccagucuacguccagcaucaacgagaaugugaacgacaagugcaaguuuacccugcccccucuuaaaauccacgaauguaauauuucuugccccaacccucugcccuuccgggaguaucgcccuaucucccagggcguuagcgaucucguggggcugccgaaucaaauuugucuucagaagacaaccucuacaauccugaaacccagacucauuuccuacacccugccuaucaacacgcgggaaggagucugcaucacagacccccugcucgccguggauaacggcuuuuucgcuuauagccaucuggagaagauuggguccuguacccgcggaaucgccaaacagagaauuaucggcguuggggaggugcuugaccggggagauaaggucccuucuauguuuaugacaaauguguggacacccccgaacccuagcaccauucaccauugcuccagcaccuaccacgaagacuucuauuacacgcugugugcugugucucaugucggcgaccccauccucaauuccaccagcuggacagagucucugagccuuauucgccuggccguuagaccuaaauccgauucuggcgacuacaaccagaaguauaucgcgaucaauaagguggaacgggggaaauacgauaaggugaugcccuauggacccagcggcauuaaacaaggggacacccucuacuuuccugccgucggauuccugccgcgcacagaguuucaguauaacgauuccaauugccccaucauucacuguaaguacagcaaagcugagaacugcagacugucuaugggcguuaauuccaagagccacuauauccuccggucugggcugcuuaaguacaaccugucccucggaggcgacauuauccugcaguucaucgaaauugccgauaaucgccuuaccaucggcagcccuuccaaaauuuacaacucucuggggcaacccguguuuuaucaggcuagcuacuccugggacacgaugaucaagcucggagauguggacacagucgauccucugagagugcaguggcggaauaacucuguuauuagccgccccggccagucccaauguccgagauucaaugugugcccugaggucugcugggaagggaccuauaacgacgccuuucugaucgaccggcucaacugggugagcgcgggagucuaccuuaauucuaaccagaccgccgagaaucccguguucgcuguuuucaaagauaacgaaauccuguaucaggugccucuggccgaggacgauacaaaugcucagaagaccauuacagacuguuuucuccuggagaacgucaucuggugcauuucccugguggaaaucuacgauacgggcgacagcguuauuagacccaaacuuuucgccgugaagaucccugcccaauguucugaguccuga

SEQ ID NO: 750 - RNA, 1605 nt, Artificial Sequence
  derived and/or modified CDS sequence (opt5) from Hendra henipavirus__AEB21206__G(70-604) (solG)
caaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcaacuacaaucagaaguauaucgcgaucaccaagguggaacgggggaaauacgacaaggugaugccuuauggacccagcggcauuaaacaaggggauacacuguacuuucccgccgucggauuccugccucgcaccgaguuucaguauaacgacuccaauugcccgaucauucacuguaaguacagcaaagcugagaacugcagacucucuaugggcguuaauuccaagagccacuauauccugcggucugggcuucugaaguacaaccucucccugggaggcgauauuauccuucaguucaucgaaauugccgacaaucgccugacgaucggcagccccuccaaaauuuacaacucucucgggcaaccuguguuuuaucaggcuagcuacuccugggauacaaugaucaagcugggagacauugauaccguggacccccugagaguccaguggcggaauaacucugugaucagccgcccuggccagucccaaugucccagauucaauguuugcccggaggugugcugggaagggaccuauaacgaugccuuucucaucgaccggcugaacugggucagcgcgggaguguaccuuaauucuaaccagacagccgagaauccugucuucgcuguguucaaagacaacgaaauucuguaucagguuccccucgccgaggaugacaccaaugcucagaagacaaucacggauuguuuucugcuggagaacgugauuuggugcaucucccuugucgaaauuuacgacaccggcgauagcgugaucagaccuaaacucuucgccguuaagauccccgcccaauguucugaguccuga

SEQ ID NO: 751 - RNA, 1605 nt, Artificial Sequence
  derived and/or modified CDS sequence (opt5) from Hendra henipavirus__AEQ38052__G(70-604) (solG)
caaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucaccaucacaaagguggaacgggggaaauacgauaaggugaugccuuauggacccagcggcauuaaacaaggggacacccuguacuuucccgcggucggauuccugccucgcacggaguuucaguauaaugauuccaacugcccgaucauucacuguaaguacagcaaagccgagaauugcagacucucuaugggcgugaacuccaagagccacuauauccugcggucugggcuucugaaguacaaucucucccugggaggcgacauuauccuucaguucaucgaaauugcugauaaccgccugacaaucggcagccccuccaaaauuuacaauucucucgggcaaccuguguuuuaucaggccagcuacuccugggacaccaugaucaagcugggagauguugacaccgucgauccccugagagugcaguggcggaacaauucuguuauuagccgcccuggccagucccaaugucccagauucaacgugugcccggaggucugcugggaagggacauauaaugacgcuuuucucaucgaccggcugaacugggugagcgccggagucuaccuuaacucuaaucagaccgcggagaacccuguguucgccguuuucaaagauaaugaaauccuguaucaggugccccucgcugaggacgauacaaacgcccagaagacgauuaccgacuguuuucugcuggagaaugucaucuggugcauuucccuuguggaaaucuacgauacaggcgacagcguuauuagaccuaaacucuucgcugugaagauccccgcccaauguucugaguccuga

SEQ ID NO: 752 - RNA, 1605 nt, Artificial Sequence
  derived and/or modified CDS sequence (opt5) from Hendra henipavirus__AEQ38115__G(70-604) (solG)
caaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauaacggcgacuacaaucagaaguauaucgcgaucaccaagguggaacgggggaaauacgauaaggugaugccuuauggacccucuggcauuaaacaaggggacacacuguacuuucccgccgucggauuccugccucgcaccgaguuucaguauaacgauagcaauugcccgaucauucacuguaaguacuccaaagcugagaacugcagacucagcaugggcguuaauucuaagucccacuauauccugcggagcgggcuucugaaguacaaccucucucugggaggcgacauuauccuucaguucaucgaaauugccgauaaucgccugacgaucggcucccccagcaaaauuuacaacucccucgggcaaccuguguuuuaucaggcuucuuacagcugggacacaaugaucaagcugggagauguggacaccgucgauccccugagagugcaguggcggaauaacuccguuauuucucgcccuggccagagccaaugucccagauucaaugugugcccggaggucugcugggaagggaccuauaacgacgccuuucucaucgaccggcugaacuggguguccgcgggagucuaccuuaauagcaaccagacagccgagaauccuguguucgcuguuuucaaagauaacgaaauccuguaucaggugccccucgccgaggacgauaccaaugcucagaagacaauuacggacuguuuucugcuggagaacgucaucuggugcauuucucuuguggaaaucuacgauaccggcgacuccguuauuagaccuaaacucuucgccgugaagauccccgcccaauguagcgagucuuga

SEQ ID NO: 753 - RNA, 1605 nt, Artificial Sequence
  derived and/or modified CDS sequence (opt5) from Hendra henipavirus__AEQ38108__G(70-604) (solG)
caaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucaccaucacaaagguggaacgggggaaauacgauaaggugaugccuuauggacccagcggcauuaaacaagggaauacccuguacuuucccgcggucggauuccugccucgcacggaguuucaguauaacgacuccaauugcccgaucauucacuguaaguacagcaaagccgagaacugcagacucucuaugggcguuaauuccaagagccacuauauccugcggucugggcuucugaaguacaaccucucccugggaggcgauauuauccuucaguucaucgaaauugcugacaaucgccugacaaucggcagccccuccaaaauuuacaacucucucgggcaaccuguguuuuaucaggccagcuacuccugggauaccaugaucaagcugggagacguggauaccgucgacccccugagagugcaguggcggaauaacucuguuauuagccgcccuggccagucccaaugucccagauucaaugugugcccggaggucugcugggaagggacauauaacgaugcuuuucucaucgaccggcugaacugggugagcgccggagucuaccuuaauucuaaccagaccgcggagaauccuguguucgccguuuucaaagacaacgaaauccuguaucaggugccccucgcugaggaugacacaaaugcccagaagacgauuaccgauuguuuucugcuggagaacgucaucuggugcauuucccuuguggaaaucuacgacacaggcgauagcguuauuagaccuaaacucuucgcugugaagauccccgcccaauguucugaguccuga

SEQ ID NO: 754 - RNA, 1605 nt, Artificial Sequence
  derived and/or modified CDS sequence (opt5) from Hendra henipavirus__AAV80426__G(70-604) (solG)
caaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagugcacgucuuccaucaacgagaaugugaacgacaaguguaaguuuacccuuccgccccugaaaauccacgaaugcaauauuagcuguccuaacccccucccuuuccgggaguaucgccccaucucucagggcguuuccgaucugguggggcuuccuaaucaaauuugccugcagaagacaaccagcacaauccucaaaccgagacugauuucuuacacccugcccaucaacacgcgggaaggagucuguaucacagacccucuccuggccguggauaacggcuuuuucgcuuauucccaucuugagaagauugggagcugcacccgcggaaucgccaaacagagaauuaucggcguuggggaggugcuggaccggggagauaagguccccuccauguuuaugacaaauguguggaccccucccaacccgucuaccauucaccauuguagcuccacauaccacgaagacuucuauuacacgcucugcgcugugagccaugucggcgacccuauccuuaauucuaccuccuggacagagagccugucucugauucgccucgccguuagacccaaaagcgauuccggcgacuacaaccagaaguauaucgcgaucaccaagguggaacgggggaaauacgauaaggugaugccuuauggacccucuggcauuaaacaaggggacacacuguacuuucccgccgucggauuccugccucgcaccgaguuucaguauaaugauagcaacuguccgaucauucacugcaaguacuccaaagcugagaauuguagacucagcaugggcgugaacucuaagucccacuauauccugcggagcgggcuucugaaguacaaucucucucugggaggcgacauuauccuucaguucaucgaaauugccgauaaccgccugacgaucggcucccccagcaaaauuuacaauucccucgggcaaccuguguuuuaucaggcuucuuacagcugggacacaaugaucaagcugggagauguugacaccgucgauccccugagagugcaguggcggaacaauuccguuauuucucgcccuggccagagccaaugccccagauucaacgugugcccggaggucuguugggaaggguccuauaaugacgccuuucucaucgaccggcugaacugggugagcgcgggagucuaccuuaacucuaaucagaccgccgagaacccuguguucgcuguuuucaaagauaaugaaauccuguaucaggugccccucgccgaggacgauacaaacgcucagaagaccauuacagacugcuuucugcuggagaaugucaucugguguauuucccuuguggaaaucuacgauacgggcgacagcguuauuagaccuaaacucuucgccgugaagauccccgcccaaugcucugaguccuga

SEQ ID NO: 755 - RNA, 1563 nt, Artificial Sequence
  derived and/or modified CDS sequence (opt6) from Nipah henipavirus__AAK50553__F(27-546) (FdelSS)
auauuacauuacgaaaaacucucaaaaauaggauuagucaaaggaguaaccagaaaauauaaaaucaaauccaacccuuuaacaaaagacauagucauaaaaaugauccccaacguuagcaauaugucacaaugcacaggaucaguaauggaaaauuacaaaacaagacuaaacggcauucuaacucccaucaaaggagcacuugaaauauauaaaaacaauacucacgaccuuguaggagacguacgacuagccggaguaauuauggccggaguagcaauagguauagcgacagccgcgcaaauaacagcaggcgucgcacucuacgaagccaugaaaaacgcagauaauauaaacaaauuaaaaucauccauugaaagcaccaacgaagcaguaguaaaacuacaagaaaccgcagaaaaaacugucuauguacuaacagcauuacaagacuauaucaauacaaaccuagucccuacaaucgauaaaauaaguugcaaacaaaccgaacuaucauuagacuuagcauuaucaaaauaccuauccgacuuacuauucguauuuggccccaauuuacaagaccccguaucuaauaguaugacaauccaagccauaucucaagcauuuggaggaaacuaugaaacacuauuaagaacacuaggauacgcaacagaagacuucgacgaccuauuagaaucagauuccauaacaggacaaauaauauacguagaccuaucaucguauuacauaauaguaagaguauacuucccaauauuaacagaaauacaacaagcauacauacaagaauuacuacccguaucauucaauaaugacaacucagaauggauaagcauaguaccaaauuucauccucgucagaaacacauugauaaguaauauagaaaucgguuucugccuaaucacaaagagaucaguaauaugcaaccaagacuacgcaacaccaaugacaaacaauaugcgcgaaugcuuaacaggcucaacagaaaaaugcccaagagaacuagucguuucaucacacguaccacgauuugcccuauccaacggaguacuauuugccaacugcaucucaguaacaugccaaugucaaacuacaggacgagcuauuucccaauccggagaacaaacacuccucaugauagacaauacaacuuguccaacagcuguacuuggaaacguaauaauuucccucggcaaauaccuaggaucaguaaauuauaauucagaaggaauagccauaggacccccaguguucaccgacaaaguagacaucucaucccaaauuucaucaaugaaccaaucucuccaacaaucaaaagauuacaucaaagaagcacaaagacuauuagauaccguaaaccccucauuaauaucaaugcuaucaaugaucaucuuauacgucuuaucaauagcaucacuaugcauaggacucaucaccuuuauauccuuuaucauaguagaaaaaaaaagaaacaccuacuccagauuagaagauagacgaguaagaccuacaucaucaggagacuuauacuacaucggcacauaa

SEQ ID NO: 756 - RNA, 1563 nt, Artificial Sequence
  derived and/or modified CDS sequence (opt6) from Nipah henipavirus__AEZ01388__F(27-546) (FdelSS)
auacuacauuacgaaaaacuaucaaaaauaggucucgucaaagggauuacaagaaaauacaaaauaaaaucaaacccccuaacaaaagacauagucauaaaaaugauaccaaacguaucaaauaugucacaauguacaggaagcguaauggaaaacuacaaaacacgacuuaacggaaucuuaacaccuauaaaaggagcuuuagaaauauacaaaaauaacacacacgaucuaguaggagauguucgacucgcaggagucauaauggcaggcguagccauagguauagcaaccgccgcacaaauuaccgcaggaguagccuuauacgaagcaaugaaaaacgccgauaacauaaacaaacuaaaaucauccaucgaaucaaccaacgaagcagucguaaaacuacaagaaaccgccgaaaaaacagucuauguccuaacagcauuacaagacuacauaaauaccaaucuuguuccaacaauagauaaaauuucaugcaaacaaacagaacuaucucucgaccuagcauuaucaaaauacuuauccgaccuacuauucguauuuggacccaaccuacaagaucccgucucuaacucuaugacaauccaagcaaucucacaagccuucggaggaaauuacgaaacauuacuaagaacacucggauaugcaacagaagacuucgacgaucuacuagaaagcgauuccauaaccggacaaauaauauacgucgaucuauccggauauuacaucauaguuagaguauauuucccaauauuaacagaaauacaacaagcauacauacaagaacuacuccccgucucuuuuaacaacgauaacuccgaauggauaucaauugucccaaacuucauacuaguccgcaauacacuaauuuccaauauagaaauagguuucugucucaucacaaaaagaucagucauaugcaaccaagacuaugcaacacccaugacaaauaacaugagagaaugccuaaccggcucaaccgaaaaaugcccacgagaacuaguuguaucuucacaugucccccgcuucgcacucucuaacggaguauuauucgcaaacugcauaucaguaacuugccaaugucaaacaacaggcagagccauaucacaaucuggagaacaaacacuauuaaugaucgacaauacaacauguccaacagcaguccuaggaaacguaauaauaucacuaggcaaauaccuaggaucaguaaacuacaacuccgaaggaaucgcaauaggaccccccgucuuuacagacaaagucgacauauccucacaaauauccucaaugaaucaaucucuacaacaauccaaagacuacauuaaagaagcacaaagacuauuagauacaguuaacccaucccucauauccauguuaucaaugauaauacuauauguccuaucaaucgcaucccucuguaucggauuaaucacauucauaucauuuauuauaguagaaaaaaaacgaaacaccuacuccagacuugaagaucgacgaguaagaccaaccucaucaggcgauuuauauuacauuggaacauaa

SEQ ID NO: 757 - RNA, 1563 nt, Artificial Sequence
  derived and/or modified CDS sequence (opt6) from Nipah henipavirus__AAY43915__F(27-546) (FdelSS)
auacuccacuaugaaaaauuaucaaaaauaggauuagucaaaggaauaacaagaaaauauaaaaucaaaucaaauccccuaacaaaagauaucguaauuaaaaugauaccaaauguaucaaauaugagucaaugcaccggaagcguaauggaaaauuauaaaacacgcuuaaacggaauacuaaccccaaucaaaggagcuuuagaaauuuauaaaaacaacacacaugauuuaguaggcgauguaagacuagcaggcguaauuauggcuggcguugcaauaggaauagcuacagcugcccaaauaaccgcuggagucgcacucuaugaagcaaugaaaaacgcugacaacauaaauaaacuaaaaucaucaauagaaagcaccaaugaagccgucguaaaacuacaagaaacagcagaaaaaacaguauacguauuaaccgcuuuacaagacuauauaaauacuaacuuaguccccacaauugacaaaauuuccugcaaacagacagaacuaucacucgauuuagcauuaucaaaauacucuuccgacuuacuauucguauucgguccuaaucuacaagacccagucuccaacuccaugacuauccaagcaauaucccaagcauuuggaggaaauuaugaaacacucuuaagaacccucggauacgcaacagaaggcuucgaugaccuacucgaauccgacaguaucacaggacaaauaauauauguagacuuaucuggauacuauauaauaguaagaguauacuuuccaauucuaacagaaauacaacaagccuacauccaagaacuauuaccuguuucauuuaacaaugacaacuccgaauggauaucaauaguacccaauuucauccuuguuaggaacacccuaauauccaacauugaaaucggauuuuguuuaauaaccaaacgaucagucaucugcaaccaagauuaugcaacaccaaugaccaacaacaugagagaaugccuaacaggaucaacagaaaaauguccacgagaacuaguagucucaucccauguaccaagauucgccuuaucuaacgguguacuauucgcaaacugcaucaguguuaccugccaaugucaaaccacaggcagagccauaucucaaucuggagaacaaacacuacucaugauagacaauacaacuuguccaaccgcaguauuaggcaacguuauaauaucauuaggaaaauaccuaggaagugucaacuauaacucagaaggaauugcuauaggaccacccguauucacagauaaaguagacauauccucacaaauaucauccaugaaccaaucauuacaacaaucuaaagauuacauaaaagaagcacaaagacuauuagacacaguaaauccaucauuaauaucuaugcuaucaaugauaauacuauauguccucucaauugcuucacuuugcauaggccuaauaaccuuuaucucauucauaauaguagaaaaaaaacgaaacacauacuccagacuagaagacagacgaguuagacccacauccucaggugaccuauauuacauaggaacauaa

SEQ ID NO: 758 - RNA, 1563 nt, Artificial Sequence
  derived and/or modified CDS sequence (opt6) from Nipah henipavirus__CAF25496__F(27-546) (FdelSS)
aucuuacauuaugaaaaacuaucaaaaauuggauuaguaaaagguguaacacgaaaauacaaaaucaaaucaaacccucuaacaaaagauauagucauaaaaaugauccccaacguaucaaacaugucacaauguaccggaucaguaauggaaaacuauaaaacgagauuaaacggaauucuaaccccaauaaaaggugcucuugaaauauauaaaaacaacacacacgaccuagucggagacguaagacuagcuggcguaauaauggccgguguagcaauaggaauagcaacagccgcacaaauaacagcuggcgucgcccuauacgaagcaaugaaaaaugcagacaacauuaacaaacuaaaaucaucaauagaauccacaaacgaagccguaguaaaauuacaagaaaccgcagaaaaaacaguauauguauuaaccgcacuucaagacuacauaaacaccaaucucguaccaacaauagacaaaauaucuuguaaacaaacagaacuaucacuagaucuagcauuaagcaaauacuuaucagacuuacucuucguauuuggaccaaaccuacaagaccccguaucaaacucaaugacaauacaagccauaucacaagcauuuggaggaaacuacgaaacacuauuaagaacacucggcuaugccauagaagacuucgacgaucuauuagaaucagauucaauaacaggccaaauaauauauguagaccucaguucauauuacaucauaguccgaguuuacuucccaauccuaacagaaauacaacaagcauacauacaagaacuacuaccaguauccuucaacaacgacaacucugaauggauaucaauagucccuaauuuuauacuaguaagaaacacauuaauaagcaacauagaaauaggauucugccuaauaacaaaaagauccguuauauguaaccaagacuacgcaacccccaugacaaacaacaugagagaaugucuaacaggcucaaccgaaaaauguccuagagaauuagucguaucaucacauguaccaagauucgcacuaucaaauggaguacucuucgcaaauuguaucucaguuaccugccaaugccaaaccaccggaagagcaauaucacaaucuggagaacaaacauuacuaaugaucgauaacacuacuugucccacagcaguucuuggaaacgucaucauaucacuaggaaaauaccuaggcucaguaaacuacaauagcgaagguauagccauuggaccaccaguuuuuacugacaaaguagacaucucaagucaaauaucaucaaugaaccaaagcuuacaacaaucuaaagauuauauaaaagaagcacaaaggcuacuagacaccgucaacccaucauuaauaagcaugcuaucaaugauaauuuuauauguauuauccaucgcuucucuaugcauaggccuaauaaccuucauaagcuucauuauuguugaaaaaaaaagaaauacauacucacgacuagaagacagaagaguccgaccaacauccucaggagauuuauauuauauaggaaccuaa

SEQ ID NO: 759 - RNA, 1563 nt, Artificial Sequence
  derived and/or modified CDS sequence (opt6) from Nipah henipavirus__AAM13405__F(27-546) (FdelSS)
auacuccauuacgaaaaacuaucaaaaauaggcuuaguuaaaggaguaacaagaaaauacaaaauaaaaucaaauccacuaacuaaagauauaguaaucaaaaugauacccaacguaucaaauaugucacaauguacuggaucaguuauggaaaauuacaaaacaagauuaaacggaauucucacacccauaaaaggagcacuagaaauuuacaaaaauaacacucacgaccuagucggcgacguaagauuagcagguguaaucauggcagguguagccaucggcauagcaacagcagcccaaauaaccgccggcguugcuuuauaugaagcaaugaaaaacgcagauaauauaaacaaauuaaaaucaucaauagaaucaacaaacgaagcuguaguaaaacuucaagaaacagcagaaaaaacaguauacguacuaacagcuuuacaagacuacaucaacacaaaccuaguaccaacgauagacaaaauaucaugcaaacaaacagaacuaucuuuagaucuagcauuaucaaaauaucuaagcgaccuucucuucguguucggucccaaccuacaagacccagucucaaacucuaugacaauacaagcaauaucacaagcauucggaggcaacuaugaaacacuacucagaacacucggcuaugccacagaagacuucgacgauuuacuagaaucagacuccauaaccggacaaauuaucuacguagaccucucgucuuacuacauaauaguaagagucuauuuccccauauuaacagaaauccaacaagcauacauacaagaacuucuaccaguaucauucaauaacgacaacucagaauggauaucaauagucccaaauuucauacuaguacguaauaccuuaaucucaaauauagaaauaggauucuguuuaaucacaaaaagaucaguaauaugcaaccaagacuacgccacaccaacgacaaacaacaugcgcgaaugucucacuggaucuacagaaaaaugccccagagaacuaguaguaucuucccacguaccacgauucgcacuguccaauggaguauuauucgcaaacugcauaagcguaacuugccaaugccaaacuaccggccgcgcaauaucacaaucaggcgaacaaacucucuuaaugauagauaauaccacaugccccaccgccguacuaggcaauguaaucaucucauuagguaaauaccuaggaucagugaacuacaacucagaagguauagcaauugguccaccaguauuuacugacaaaguagacaucagcucacaaauauccucaaugaaucaaucauuacaacaaucaaaagacuauaucaaagaagcacaaagacucuuagacacaguaaacccaagcuuaauuagcaugcuauccaugaucauacucuauguacuuucaauagcaucccuuugcaucggacuaauaacuuuuaucucauucaucaucguagaaaaaaaacgaaacacuuacucaagacuagaagauagaagaguaagacccacaucaaguggagacuuauauuauauaggaacauaa

SEQ ID NO: 760 - RNA, 1563 nt, Artificial Sequence
  derived and/or modified CDS sequence (opt6) from Nipah henipavirus__CBM41033__F(27-546) (FdelSS)
auacuccauuacgaaaaacuuucaaaaauaggcuuaguaaaaggaguaacaagaaaauauaaaauaaaaucaaacccccuaacuaaagauauaguaauaaaaaugaucgcaaacguuucuaacaugucccaauguacaggaucaguaauggagaacuauaaaacaagauuaaauggaauauuaacaccaaucaaaggcgcacucgaaauauacaaaaacaacacacacgacuugguaggugauguacgacuagcaggagucaucauggccggcguagcaauaggaauagcuacagcagcacaaauaacagcaggaguagcauuauacgaagcaaugaaaaaugccgauaacauaaacaaauuaaaaucaucuauagaaucaacaaaugaagccguaguaaaacuacaagaaacagccgaaaaaacaguuuacguucuuacagccuuacaagauuauaucaauacaaauuuaguaccuacuaucgauaaaauauccugcaaacaaacagaacucucacucgaccuagcccucucuaaauaccuuucugauuuauuauucguauucggaccaaacuuacaagaucccguuucaaauuccaugacuauacaagcaauaagccaagcauuuggaggaaacuacgaaacacuucuaagaacauuagguuacgcaacugaagacuuugacgaccuacuagaaucagacucaaucacaggacaaaucaucuacguagacuuaucuucauacuacauaaucguccgaguauacuucccaauauuaacagaaauucaacaagccuauauacaagaacuacucccaguauccuuuaauaaugacaacucagaauggauaucaauagucccuaacuucauacuaguaagaaacaccuuaauuucaaacaucgaaauaggcuucugccuaauaaccaaacgaucaguaauaugcaaccaagacuacgcaacuccaaugacaaauaauaugcgagaauguuuaacaggaaguacagaaaaaugccccagagaauuagucguaucaucucaugucccaagauucgcacuaucaaauggaguacuauucgcaaacugcauaucaguaacaugucaaugucaaacuacuggccgugcaauaucucaaucaggagaacaaaccuuacucaugauagacaacacaaccugcccaacagcuguacuuggcaacguaauaaucucacuaggaaaauaccuaggaaguguaaacuauaacucugaggggauagcaauaggcccaccaguauucacagauaaaguagacauuagcucccaaaaaucaucuaugaaucaaucacuccaacaaucaaaagacuacauaaaagaagcacaacgcuuauuagacacaguaaauccaucacuaauaucaaugcuaucaaugauaauauuauacgucuuauccauagccagcuuauguauaggcuuaauaaccuucauauccuucauaaucguagaaaaaaaacgcaauaccuacucacgacucgaagacagacgaguaagaccaaccuccuccggagaccuauacuauaucggcacauaa

SEQ ID NO: 761 - RNA, 1563 nt, Artificial Sequence
  derived and/or modified CDS sequence (opt6) from Nipah henipavirus__AEZ01396__F(27-546) (FdelSS)
aucuuacacuacgaaaaacucuccaaaauaggccuaguaaaaggcauaacacgaaaauauaaaauaaaaucuaacccacuaacaaaagacaucguaauaaaaaugaucccaaacguauccaacaugucacaaugcacaggcucaguaauggaaaauuacaaaaccagacuaaauggcauuuuaacaccaauaaaaggagcacuagaaauuuacaaaaacaacacacacgaccuagucggagauguacgacuagccggagucauaauggcaggaguagcaauaggaauagccaccgcagcucaaauaacagcaggagucgcccuauaugaagccaugaaaaaugcugauaauauaaacaaauuaaaaucuucaaucgaaucaacaaacgaagcaguagucaaacuacaagaaacagcagaaaaaacagucuauguacuaacagcccuacaagacuacauaaacacaaauuuagucccuaccauagauaaaauaagcuguaaacaaacagaacucucacuagaccuagcccucucaaaauaccucucagaccuauuauuuguauucggacccaaccuccaagacccagucucuaacucuaugacaauacaagcgauaucccaagcauucggcgguaauuacgaaacauuacugcguacacuuggcuacgcaacagaagacuuugacgacuuauuagaaucagauucaauaaccggacaaauaauauacguagacuuauccggcuacuacauaauagucagaguauauuucccaauauuaaccgaaauccaacaagccuacauacaagaacuacuaccaguuucauucaacaaugauaacucugaauggaucucuaucguuccaaacuuuauuuuagugagaaacacccuaauaucaaacauugaaauaggcuucuguuuaauaacuaaaagaucaguuauaugcaaccaagacuacgcaacacccaugacaaauaacaugagagaaugccuaaccggcucaaccgaaaaaugcccacgagaauuagucguaucaucacacguaccacgcuucgcacucucaaauggaguccuuuucgcaaacugcauaucagucacuugucaaugccaaaccacaggcagagccauaucccaaucaggcgaacaaacccuacucaugauagacaauacaacauguccaacagcuguccucggcaauguuauaauaucccucggcaaauauuuagguucuguaaacuacaacucagaaggaauagcuaucggaccucccguauuuacagacaaaguagacaucucaucucaaauaucaucaaugaaccaaucccuacaacaaaguaaagacuacauaaaagaggcacaaagacuacuagacaccguaaacccguccuuaaucucuauguuaagcaugaucauacuauacguauuaucaauugcaucauuaugcauaggauuaauaacauucauuucauucauaauaguagaaaaaaaacgaaacaccuauucacgauuagaagaucgaagaguacgaccaacuagcuccggcgaccuauauuacaucggaacauaa

SEQ ID NO: 762 - RNA, 1563 nt, Artificial Sequence
  derived and/or modified CDS sequence (opt6) from Hendra henipavirus__NP_047111__F(27-546) (FdelSS)
auccuacacuacgaaaaacuaucaaaaaucggccuagucaaaggaauaacacguaaauacaaaauuaaaucuaacccacuaaccaaagacauaguaauaaaaaugauuccaaacguuagcaacgucucaaaaugcacaggaacagugauggaaaacuauaaaucaagacuaacaggaauacuaucccccauaaaaggugcaaucgaauuauacaacaacaauacccaugaucuaguaggagauguaaaauuagcuggaguugucauggccggcauagcaauaggaauugcaacagcagcccaaauaacagccggaguagcucuauaugaagcaaugaaaaacgccgauaauauaaacaaacuaaaaucgucaauagaaucaacuaaugaagcaguugucaaacuacaagaaacagcagagaaaacaguauacguccucacagcuuuacaagauuauauaaacacaaacuugguacccacaauagaucaaauaucuuguaaacaaaccgaacuagcacuagaccuagcacuguccaaauaccucucagaucuucuauucguauucggcccuaaccuacaagaccccguuucaaacucuaugacaauucaagcaauaucacaagccuucggaggaaacuacgaaacacuacucaggacacucgguuaugcaacagaagacuuugaugaucuucuugaaucagauucaauagcaggucaaauuguauacguagauuuauccucauacuacauaauaguaagagucuacuucccaauauuaacugaaauucaacaagcauacgugcaagaauuacuaccaguaucauucaacaacgauaacucagaauggauaaguauaguaccaaauuucguacucauaagaaauacucuaauaucaaacauagaagucaaauauugcuuaauuacaaagaaauccguaaucuguaaccaagacuacgcaacccccaugacagcaucugucagagaaugucucaccggaucaacagauaaaugcccacgagaauuaguaguauccucacacguaccuagauucgcauuaucaggcggaguccuauucgcaaauugcauaucuguaacaugccaaugccaaacaacaggacgugcaauaucccaaucaggagaacaaacacuauuaaugauagacaauacuaccuguacaaccguaguacucgguaacauaauaauaagucuaggaaaauauuugggaaguauaaacuacaauucagaaucaauagcaguaggaccacccguauacacagauaaaguagacauauccucacaaauuucaucgaugaaucaaucacuccaacaauccaaagacuacaucaaagaagcacagaaaauacuagacacaguaaaccccucacuuauauccauguuauccaugauaauucuauacguucucuccaucgcagcccuaugcauaggauuaauaacuuucauuucauucgucauaguagaaaagaaaagaggaaacuauaguagauuagaugacagacaagucagaccagucucaaacggcgauuuauacuacauaggcacauaa

SEQ ID NO: 763 - RNA, 1563 nt, Artificial Sequence
  derived and/or modified CDS sequence (opt6) from Hendra henipavirus__AEB21233__F(27-546) (FdelSS)
auacuacauuaugaaaaauuauccaaaauaggauuaguaaaaggaauuacaagaaaauacaaaauaaaaagcaauccucuaacaaaagacauaguaauaaaaaugauccccaauguaucuaacguaucaaaaugcacaggaacagucauggaaaauuacaaaucaagacuaacuggaauucuaucaccaauuaaaggcgcuauagaacuauacaauaauaacacacacgaucuuguaggcgacguaaaguuagcgggaguuguaauggcaggaauugccauagguaucgcaacagcagcccaaauaaccgcaggcguagcacuauacgaagccaugaaaaaugcagauaacauaaauaaauuaaaauccaguauugagucaacaaaugaagcaguaguaaaacuccaagaaacagcagaaaaaacagucuauguacucacagcccuucaagauuacaucaauacaaaccuaguaccaacaauagaccaaauaucauguaaacaaaccgaauuagcacuagaccuagcacuuucaaaauacuuaagugaccuuuuauuugucuucggccccaaccuacaagacccaguauccaacaguaugacaauacaagccauaagucaagcauucggagguaacuacgaaacccuccuaagaacccuaggauacgcaacagaagacuuugacgaccucuuagaaagcgauucaaucacaggacaaauaguuuacgucgacuuaucuaguuacuacauaauaguaagaguauacuuccccauucuaacugaaauucaacaagcauacguacaagaauuacuaccaguaucauucaacaacgacaacucagaauggaucucaauaguuccaaacuuuguacuaauucgaaauacacuaaucucaaauauagaaguaaaauacugccuuauaacaaaaaaauccguaauaugcaaccaagacuaugcaacaccaaugaccgcaucaguucgagaaugccucaccgguuccacagauaaauguccaagagaauuaguaguaucuucacacguaccaagauucgcuuuaucaggaggcguucuauuugcaaacugcaucagcgucacaugccaaugucaaacaacuggccgagcaauaucacaaucuggagaacaaacacucuuaaugauagacaacacuaccugcacaacaguaguacucggaaacaucauaauaucacuuggaaaauaccucggaucaauuaacuauaacagugaaucaaucgcuguuggucccccaguauauacagacaaagucgacaucagcucacaaauuucaucaaugaaccaaucacuucaacaaucaaaagauuauauaaaagaagcacaaaaaauacuagacacaguaaacccaucuuuaauuucaauguuaucaaugauaauauuauauguucuaucaauugccgcacuaugcauuggauuaauaaccuuuauaucuuuuguaauaguugaaaaaaaaagagguaauuauucucgccuugacgaucgccaaguacgcccaguauccaacggugaccucuauuauauuggaaccuaa

SEQ ID NO: 764 - RNA, 1566 nt, Artificial Sequence
  derived and/or modified CDS sequence (opt6) from Hendra henipavirus__AEQ38114__F(26-546) (FdelSS)
ggaauucuacauuacgaaaaacuuagcaaaauaggacuaguaaaaggaauaacccgaaaauacaaaauaaaaucaaacccccuaacaaaagacauaguaauaaaaaugauaccaaaugucucaaacgucagcaaaugcacaggcaccgucauggaaaauuacaaaucacgacuaacaggaauauuaucaccaauaaaaggagcaaucgaacuauacaacaacaacacacacgaucuaguaggcgacguaaaacuagcaggaguagucauggccggaauagcaauaggaaucgcaacagcagcucaaauaacagcaggaguagcacuuuacgaagcuaugaaaaacgcagacaauauaaacaaacuaaaaucaucaaucgaaucaacaaacgaagcuguuguaaaauuacaagaaacagcugaaaaaacuguauacguccuaacagcccuccaagauuacaucaacacaaacuuagucccaacaauugaucaaauuucaugcaaacaaacagaacuagcucuagaucuagcccuaucaaaauaccuaucugaccuacuauuuguauucggucccaauuuacaagaucccguaucaaauucaaugacaauacaagcaauuagccaggcuuucggaggaaauuaugaaacacuacuacgcacacuaggauacgcgacagaagacuuugacgacuuauuagaaucugauucaauaaccggucaaaucguauauguagacuuaagcucuuacuacaucauaguuagaguauacuucccaauccucacagaaauacaacaagccuacguccaagaauuauuaccaguaucuuucaacaacgacaacucagaauggauaucaauaguuccaaacuucguuuuaauaagaaacacacuaaucucaaauauagaagucaaauacugcuuaauaaccaaaaaaucaguaauaugcaaccaagauuacgccacaccaaugaccgcuucaguacgagaaugccuaacaggaucaacagauaaaugccccagagaauuaguuguaucaucccacguuccaagauucgcacuaucaggaggaguacuuuucgcaaauugcauaucaguuacuugccaaugccaaacaaccggacgcgcaauuucucaauccggagaacaaacacuacuaaugaucgacaacacaaccugcacaacaguaguacuaggaaauauuauaaucucacuaggcaaauacuuagguucuauaaacuauaacagugaaucaauagcuguaggaccaccaguauacacagacaaagucgacauuucuucacaaauuucuucaaugaaucaauccuuacaacaaaguaaagacuauauaaaagaggcacaaaaaauacuugacaccguaaaucccucacuuauaucaauguuaucaaugaucauccucuacguacuaucaaucgcagccuuaugcauaggacuaauaacauuuauuucauuuauaauaguagaaaaaaaacgaggcaauuacaguagacuagacgacagacaaguacgaccuguaucaaauggugaccucuacuacauaggaacauaa

SEQ ID NO: 765 - RNA, 1563 nt, Artificial Sequence
  derived and/or modified CDS sequence (opt6) from Hendra henipavirus__AAB39505__F(27-546) (FdelSS)
auacuacacuacgaaaaauuaaguaaaaucggccuagucaaaggaauuacccgaaaauacaaaaucaaaucuaacccauuaaccaaagacauagucauaaaaaugauuccaaacgucucaaacguaucaaaaugcacuggaaccguaauggaaaacuauaaaucacgauuaaccggaauacuaucaccaauuaaaggagcaaucgaacuuuauaacaauaacacacacgaccuaguuggcgacguaaaacuugcagguguaguaauggcagguaucgccaucggaauagcaacugcagcucaaaucacagccggaguagcucucuacgaagccaugaaaaacgcagacaauauaaacaaauuaaaaucaagcauagaaucaaccaacgaagcaguuguuaaacuucaagaaaccgcugaaaaaaccguauauguucuaacagcacuacaagacuauauaaacacaaaccuaguacccacaaucgaucaaauuuccugcaaacaaaccgaacuagcccuugaucuugcacucagcaaauauuuacucauauguucauguuucggcccaaaucuacaagauccaguauccaauucaaugaccauacaagcaaucucacaagcauuuggagguaacuacgaaacacuccuaagaacauuaggcuacgcuacagaagauuucgaugaccuccucgaaucagacuccauaacaggacaaauaguauacgucgaccuaucauccuacuacauaauagucagagucuacuucccaauacuaacagaaauucaacaagcauauguacaagaacuacuaccugucucauucaacaacgacaacucugaauggauauccauaguccccaauuuuguccuaauaagaaacacacuaaucucaaacauagaaguuaaauauugcuuaauaaccaaaaaaucagucauauguaaccaagacuacgcaacaccaaugaccgcaucaguaagagaauguuuaacagguaguacagacaaauguccaagagaauuaguaguuagcucccacguaccaagauuugcacuaucaggcggcguacuauucgcuaacugcauaaguguaacaugucaaugccaaaccacugggcgagcaaucucacaaucucgagaacaaacacuucuaaugauagacaacacaacaugcaccacaguaguucuaggcaauaucauaaucucacuaccaaaauacuuaggauccauaaaacuucaaguacuaagagcuuuacuccucggccaccaaucaauccaaaccaaaguugacauaucuucacaaauaucaucaaugaaucaauccuuacaacaauccaaagacuauaucaaagaagcacaaaaaauuuuagauacuguuaaccccaguuuaauaucuaugcuaucaaugauuauauuauacguccucaguauagcagcauuaugcauaggacucauaacauuuauaucauucguaauaguugaaaaaaaacgaggaaauuacucaagacuugacgacagacaaguaagaccaguaucaaauggagauuuauacuacaucggcacuuaa

SEQ ID NO: 766 - RNA, 1599 nt, Artificial Sequence
  derived and/or modified CDS sequence (opt6) from Nipah henipavirus__AAK50554__G(70-602) (solG)
caaaacuauacacguucuaccgauaaucaagcuguaauuaaagacgcauuacaaggaauucaacaacaaauaaaaggccuugccgacaaaauaggcacagaaauuggcccaaaaguaucuuuaauugacaccucaaguaccauaaccauacccgcuaauauaggacuauuaggcucaaaaauaucacaaucaacugcaucaauuaaugaaaacguaaacgaaaaaugcaaauuuacacuaccaccucuaaaaauccaugaaugcaacauaucuugcccaaaccccuuaccauuuagagaauaccgcccacaaacagaaggcguaucaaaccuaguaggccuacccaacaacauaugccuacaaaaaacaucuaaccaaauuuuaaaaccaaaauuaauaucuuacacauuaccagucgucggacaaagcggaaccugcauuacagacccacuacuagcaauggacgaaggauacuucgcauauucacaucuagaacguauaggaucauguucacguggugucucaaaacaacgaauaauaggaguaggcgaaguauuagaucgaggagacgaaguuccguccuuauucaugacaaaugucuggaccccaccaaaccccaacacaguguaccacugcucagcaguuuacaauaacgaauuuuauuacguacuaugcgcaguuucaacagucggagacccaauacuaaacaguacauauuggagcggaucauuaaugaugacaaggcucgccgucaaaccaaagagcaacggugguggauacaaucaacaccaacuagcacuaagaucaauagaaaaaggaagauacgacaaaguaaugccauacggcccaucaggaaucaaacaaggagauacauuauacuucccagcagucgguuuucuaguaagaacagaauuuaaauacaacgauucaaauuguccaaucacaaaaugccaauauucaaaaccagaaaacugcagacuaucgaugggaauacgcccaaacucccacuacauacuuagaucuggacuauuaaaauacaauuuaagcgauggagaaaacccaaaaguagucuucauugaaauaucagaccaaagacuaucaauaggaucaccaucaaaaauauaugacucacuaggacaaccaguauucuaccaagcuucauucucaugggauacaaugauuaaauuuggagauguauuaaccguaaaucccuuaguaguaaauuggagaaauaacacuguaauuucuagaccaggacaaagccaauguccgagauucaauacaugucccgaaauaugcugggaaggaguauacaaugacgcauuccuaaucgaucgaaucaacuggauaagugcaggcguauuccuagacucaaaucaaacagcagaaaacccagucuucacaguauucaaagacaaugaaauacucuauagagcacaacucgcuucagaagacacuaaugcacaaaaaacaauaacaaacuguuuuuuacucaagaacaaaaucuggugcauuucauuaguagaaaucuacgacacaggagacaaugucauuagaccaaaacuauucgcagucaaaauaccagaacaauguacauaa

SEQ ID NO: 767 - RNA, 1599 nt, Artificial Sequence
  derived and/or modified CDS sequence (opt6) from Nipah henipavirus__AEZ01389__G(70-602) (solG)
caaaauuacacaagaucaacagacaaucaagccaugauaaaagacgcucuacaaagcauucaacaacaaauuaaaggcuuggcagacaaaauaggcacagaaauaggcccaaaaguaagcuuaauagacaccucuaguacaauuacaauacccgcaaauauaggguuauuaggaucaaaaauaagccaaaguacagccuccauaaacgaaaauguaaacgaaaaaugcaaauuuacucuaccaccacuaaaaauacaugaauguaauauauccugcccaaacccacucccauucagagaauacaaaccacaaacagaggguguaucaaauuuaguaggauuaccuaacaauauaugucuacaaaaaaccuccaaccaaauacuuaaaccuaaacuaauaucauacacacucccaguaguaggacaaagcggaacauguauaacagacccacuccuagcaauggacgaaggauacuuugcauauagucaccuagaaaaaauaggaucauguagccgaggcgucaguaaacaaagaauaauaggaguaggagaaguacuagaccgaggagaugaaguaccuucacuauuuaugacaaacguauggacuccuucaaacccaaauacaguauaucacugcucagccgucuacaacaaugaauucuacuacguguuaugcgcaguaucaguaguaggagauccaauauuaaacagcacauauuggucaggaucuuuaaugaugacaaggcuagcagucaaacccaagaacaacggagaaucauauaaccaacaccaauucgcacuaagaaacauagaaaaaggaaaauacgacaaaguaaugccauacggaccaucagguauuaaacaaggagacacccuuuacuucccagcagucggguuucuaguaagaacagaauuuaaauauaaugacucaaauugcccaauagcagaaugucaauauuccaagccagaaaauugccgacucuccaugggaauaagaccuaacucacauuacauucuaagauccggacuucuaaaauacaauuuaucagaugaagaaaauaguaaaauaguauucauagaaauuagcgaucaacggcuuucaauaggaucaccaucaaaaaucuacgauucauuaggccaacccguuuuuuaucaagcaucauucuccugggacacaaugauaaaauuuggagacguacaaacuguaaacccacuaguaguaaauuggagagacaacacaguaauaucacgacccggucaaucccaaugcccucgauuuaacaaaugcccagaaguaugcugggaaggaguauacaacgacgcauuucuuauugaccgcauaaacuggauaucagcaggugucuuccuagauucaaaccaaacugcugaaaaccccguauucacaguauucaaagacaacgaaguacucuacagagcucaacuagcaucugaagauacaaacgcacaaaaaaccauaacaaacugcuucuuauuaaaaaacaaaaucuggugcaucucacuaguagaaauauacgauacaggagacaaugucauaagaccaaaacuauucgcaguaaaaauccccgaacaaugcacauaa

SEQ ID NO: 768 - RNA, 1599 nt, Artificial Sequence
  derived and/or modified CDS sequence (opt6) from Nipah henipavirus__ACT32615__G(70-602) (solG)
caaaacuauacaagaucaacagacaaucaagccaugauaaaagacgcuuuacaauccauccaacaacaaauaaaaggacuagcagauaaaaucggcacagaaauaggaccuaaaguaucucugauagauacuucaucaacaauaacuauaccagccaauauaggucuucuggguucaaaaauaucacaauccacugccuccaucaacgaaaacguaaaugaaaaaugcaaauuuaccuuacccccauuaaaaauacacgaaugcaacauaucauguccaaacccacuaccauucagagaauauaaaccucaaacagaaggagucucaaaccuaguuggcuuaccaaauaacaucugccuacaaaaaacauccaaccaaauauuaaaacccaaacuaauuucauacacacuuccaguaguaggacaauccggaacuuguauaacagaccccuuacucgcaauggacgaaggauacuuugcauauucccaccucgaaaaaaucggaucuugcucacgaggcguaucaaaacaacgaauuauaggaguaggagaaguauuagacagaggugaugaagucccaucauuauuuaugacaaacguauggacuccaagcaacccaaacacaguauaucacuguuccgccgucuacaauaacgaauucuacuaugucuuaugcgcuguaucaguaguaggugaccccguucuaaacucaacauacuggucuggcucacuaaugaugacaaggcuagccguaaaaccaaaaaauaacggagaaucauauaaucaacaccaauucgcacuaagaaacauagaaaaaggaaaauacgacaaagucaugccuuacggcccuuccggaauaaagcaaggagacacacuauauuuuccagccguagguuucuuaguacgaacugaauuuaaauauaacgacucaaacugccccaucgcugaaugucaauauucaaaaccagaaaauugcagacuaucaaugggaauaagaccaaauucacacuacauacuaagaagcggacuccuuaaauacaacuuaucagaugaagaaaacucuaaaauagucuucauagaaauauccgaccaaagacuauccauaggaucaccaucaaaaauauacgacucacuaggucaaccaguauucuaccaagccagcuucucaugggacaccaugauuaaauucggugauguacaaacagucaauccccuaguugucaacuggcgagacaauacaguaauauccagaccaggacaaucucaaugccccagauucaacaaaugucccgaaguauguugggaaggaguuuauaacgacgccuuucuaauagacagaaucaacuggauuucugcuggcgucuuccuagauucaaaccaaacagcagaaaacccaguauuuacuguauucaaagacaaugaaguacuauaccgugcacaauuagcaucugaagacacaaacgcacaaaaaacaaucacaaacugcuuucuacuaaaaaauaaaauauggugcauaucacuagucgaaauauacgacacaggcgacaacgucaucagaccuaaacuauucgcugucaaaauacccgaacaauguacauaa

SEQ ID NO: 769 - RNA, 1599 nt, Artificial Sequence
  derived and/or modified CDS sequence (opt6) from Nipah henipavirus__CAF25497__G(70-602) (solG)
caaaauuauaccagaucuacagauaaucaagcaguuauaaaagaugcacuucaaggaauacaacaacaaauaaaaggucuagcagacaaaauaggaaccgaaauaggaccgaaagucucacuaauagacacuucaucaacuaucacaauaccagcaaauauaggccuacuaggaucaaaaauaagucaaagcacagcaucaauaaaugaaaauguaaacgaaaaaugcaaauuuacacucccaccccuaaaaauacaugaauguaacauaucaugcccaaacccacuacccuuucgagaauaccgcccucagacagaaggcgucuccaaccucguaggauuaccaaacaauauaugccuccaaaaaacuagcaaucaaauucuaaaaccaaaacuaauaucuuacacauuaccaguaguaggacaaucaggcacaugcauaacagacccacuuuuagcaauggacgaaggauacuucgcauauucacauuuagaacguauuggaucaugcucaagaggaguauccaaacaaagaauaauaggaguaggcgaaguccuagaccgaggcgaugaaguacccucccucuucaugacaaacgucugggcaccuccaaacccaaacacaguuuaucauugcuccgcaguauacaauaacgaauucuacuacguccuaugugcaguauccacagucggcgacccuauauuaaacuccacuuacuggagcggaucauuaaugaugaccagacuagccguaaaacccaaaaguaacggcgguggauauaaccaacaccaauuagcauuacguucaauagaaaaagggagauacgauaaaguaaugccauacgguccaucaggaauaaaacaaggagacacacuauacuuucccgcagucggcuucuuagucagaacagaauucaaauauaacgacucaaacugucccauaacaaaaugccaauauucaaaaccugaaaacugcagacuaucaaugggaauccgaccaaauucucacuacauccuuagaucaggcuuacugaaauauaaucucucagacggagaaaauccaaaaguaguauucaucgaaauaucagaucagagacuaucaauuggaucacccaguaaaauauacgacucucucggacaaccaguauuuuaccaagcuuccuucucaugggauacaaugauaaaauucggagacguacucacaguaaauccacucguaguaaacuggagaaauaauacaguuaucucacgucccggacaaucacaaugcccaagauucaacacauguccagaaauaugcugggaaggaguauacaaugaugcauuuuuaauagaccgaauaaauuggauaagugcaggaguauuuuuagacucaaaccaaacagcagaaaaccccguuuuuacaguauucaaagauaacgaaauauuauaccgugcccaacuagcaucugaagacacaaaugcacaaaagacuaucacuaauugcuuucuauuaaaaaacaaaauaugguguauaucuuuagucgaaauauacgauacaggagauaacguaauaagaccaaaacuguucgcaguaaaaauuccugaacaaugcacauaa

SEQ ID NO: 770 - RNA, 1599 nt, Artificial Sequence
  derived and/or modified CDS sequence (opt6) from Nipah henipavirus__CBM41034__G(70-602) (solG)
caaaauuauacucgauccacagauaaccaagcugucauaaaagacgcauugcaagguauacaacaacaaauaaaaggucuagcugacaaaauuggaacagaaauaggaccaaaaguaucacugauagacacaucaucaaccauaaccauaccagcaaauauaggccuacuaggauccaaaauaucacaaagcaccgcauccauaaacgaaaacguaaacgaaaaaugcaaauuuacauuaccaccgcuaaaaauacaugaaugcaauauaucaugcccaaauccacuaccauucagagaauaccgaccacaaaccgaaggaguaagcaaucuaguaggacuaccagauaauauaugcuuacaaaaaacaucaaaucaaauccucaaaccaaaauuaauaucuuauacccuaccaguaguaggacaaagcgguaccugcauaacagacccacuacuagcuauggaugaaggauacuuugcuuacagccaccuagaacgaauaggaaguuguaguagaggaguaucaaaacaaagaauaauaggaguuggcgaagucuuagauagaggcgacgaaguaccaucacucuucaugacaaauguauggacacccccaaauccaaauacaguauaccacuguuccgcaguauacaauaaugaauucuacuacguauuaugcgcaguaagcacaguaggagauccaauacuaaauaguacauacuggucaggaucacuaaugaugacaagauuggcaguuaaaccaaaaucaaacggaggaggcuacaaucaacaccaacuagcacuaagaaguauagaaaaagguagauaugacaaaguaaugccauacggucccucaggaauaaaacaaggugacacacuauauuuuccagcagucggauuucucguaagaacagaauuuaaauauaaugauucaaacugcccaauuacaaaaugccaauauucaaaaccagaaaacuguagacuauccaugggaauaagaccaaacucucauuacauacuaagaucaggacuccucaaguauaacuuaucugauggagaaaaccccaaaauagucuuuauagaaaucucagaccaacgcuuaagcauagguucaccaucaaaaguauacgauagccuaggccaaccaguauuuuaccaagcaucauuuaguugggacacaaugauaaaauucggugauguucaaacaguaaaucccuuagucgucaauuggcgagauaacacaguaauaucuagacccggacaaagccaauguccacgauuuaacacauguccagaaauauguugggaaggcgucuauaacgacgcguucuuaauagacagaauaaacuggauaucagccggaguauuccuugacagcaaucaaacagcagaaaacccaguauuuacagucuucaaagauaaugaaauacuauaucgagcucaacuagcuagcgaagacacaaaugcacaaaaaaccauaaccaauugcuucuuacuaaaaaacaaaauauggugcauaucacuaguagaaauauacgauacgggagauaacgucauacgaccaaaacucuucgcaguaaaaauaccagaacaauguacauaa

SEQ ID NO: 771 - RNA, 1599 nt, Artificial Sequence
  derived and/or modified CDS sequence (opt6) from Nipah henipavirus__AAX51853__G(70-602) (solG)
caaaacuacacaagaagcacugacaaucaagcaguaauuaaagacgcccuacaaggaauacaacaacaaauaaaaggacucgcagacaaaauagguacugaaauaggccccaaagucagucuaauagacaccucaucaacaaucacaauaccugcaaauaucggccuauuaggaucaaaaauaucacaaucaacugccucaaucaacgaaaacguaaacgaaaaauguaaguucacacuuccaccucucaaaauacacgaauguaauauaucaugccccaacccacuaccauuucgagaauacagaccucaaacagaaggaguuucuaaccuaguuggcuuaccaaauaacauaugucuucaaaaaacuuccaaucaaauacuaaaaccaaaacuaauaucauacacccuaccagucguuggccaaucaggaacauguauaacagauccacuauuagcaauggacgaaggauacuucgcauacucacaccuagaaagaauaggaucuuguucaagagguguaucaaaacaaaaaauaauaggaguaggagaaguucuagaccgaggagacgaaguaccaucgcuauucaugacaaaugucuggacaccacccaacccaaauacaguauaucacugcagugccguauacaacaaugaauuuuacuauguccuaugcgcagucucaacaguaggagacccaauccuaaacuccacauacuggucaggaagucuuaugaugacucgucucgcagucaaaccaaaguccaacgacggaggauauaaccaacaucaauuagcccuaagaagcauagaaaaaggaagauacgacaaagucaugccauacggccccucaggaauuaaacaaggagauacauuauauuucccagcaguaggauuucuaguacgaacagaauucaaauacaacgauucaaauugccccauaacaaaaugccaauacaguaaaccagaaaacugucgacuuagcaugggaauacgaccaaacucucacuauguacuaagaucuggccuccuaaaauauaaucuaucagacggugaaaaccccaaaauaguauucauagaaauauccgaccaaagauuauccauaggaucaccaucaaaaauauaugacuccuuaggucaaccagucuuuuaccaagcaucuuuuuccugggacacaaugauaaaauucggagauguacaaacaguaaacccucuaguuguaucuuggagagacaacacaguaauaucacgcccuggccaaucacaaugcccacgcuucaacacauguccagaaauaugcugggaaggcguauacaacgacgccuuucucauagacagaauaaacuggauaucagccggaguauuccuagacuccaaucaaacagcagaaaauccaguauuuacuguauucaaagauaacgaaauauuguacagagcacaacuagcaagugaagauaccaacgcccaaaaaacaaucaccaacugcuucuuauuaaaaaacaaaauauggugcaucucacuaguagaaauauaugauacaggcgacaauguaaucagaccaaaauuauucgcaguaaaaauacccgaacaaugcacauaa

SEQ ID NO: 772 - RNA, 1599 nt, Artificial Sequence
  derived and/or modified CDS sequence (opt6) from Nipah henipavirus__AEZ01397__G(70-602) (solG)
caaaacuacacucguucaacagacaaucaagcaaugaucaaagacgcacuacaauccauucaacaacaaauaaaaggcuuagcagacaaaauuggcacagaaauaggaccaaaaguaucacuaauagacaccagcaguacaauaacaaucccugccaacauaggccuauuaggaucaaaaauaucacaauccacagcauccauaaaugaaaauguaaacgaaaaaugcaaauuuacacuaccaccacuaaagauucacgaaugcaauauaucuugcccaaauccacuaccauucagagaauauaaaccccaaaccgaaggagucuccaaucucgucggccuaccuaacaacaucugcuuacaaaaaacauccaaccaaauauuaaaacccaaauuaauaucauacacacuaccaguaguaggacaauccggaacaugcauuacagacccacuacucgccauggacgaaggauauuuugcauauucacacuuagaaaagauaggaucauguucaagaggagucucuaaacaaagaauaaucggcgucggugaaguccuagauagaggagaugaaguccccucgcuauucaugacaaacgucuggacaccaucaaauccuaauacaguauaccauuguucugcagucuauaacaacgaauucuacuaugucuuaugcgcaguaucaguagugggagacccaauccuaaacuccacauacuggucaggaagccuaaugaugacacgacuagcugugaaaccaaaaaauaacggugaaucauacaaccaacaucaauucgcauuacgaaacauagaaaaaggcaaauaugacaaaguaaugccauauggaccauccggaauaaaacaaggcgacacauuauauuuccccgcaguaggauuucuuguucgaacagaauuuacauacaacgauucaaacuguccaauagccgaaugccaauacucuaaacccgaaaauugccgucuaagcaugggaauacgaccaaacucacacuacauacucagaucaggauuacuaaaauacaaucucucagacgaagaaaacuccaaaauaguauucaucgaaauaucugaucaacgacuauccauuggcucacccucaaaaauauaugacucacuaggacaaccaguauucuaccaagccaguuuuucuugggacaccaugaucaaauucggagacguucaaacaguaaacccccucguaguaaauuggcgagacaauacaguaaucuccagaccaggucaaucgcaaugucccagauuuaacaaauguccagaagucuguugggaagguguauacaaugaugcauuucuuauagacagaauaaauuggauaucagcaggaguuuuuuuagacucuaaccaaaccgcagaaaacccagucuucacaguauucaaagacaaugaaguacuauaccgcgcacaauuagcaagcgaagacacaaacgcacaaaaaacuauaacuaauugcuucuuauuaaaaaacaaaauaugguguauaucucucguagaaauauacgauacaggagacaacguaaucagaccaaaauuauucgcaguaaaaauaccagaacaaugcacauaa

SEQ ID NO: 773 - RNA, 1605 nt, Artificial Sequence
  derived and/or modified CDS sequence (opt6) from Hendra henipavirus__NP_047112__G(70-604) (solG)
caaaauuacacaagaacuacagauaaucaagcccucauaaaagaaucccuacaauccguucaacaacaaaucaaagcccuuacagacaaaauaggaacagaaauagguccaaaaguaucacuaauugauacaucuucaacaauuacaauaccagcaaacauaggcuuauuaggaucuaaaauaucacaaucaacaagcucuauuaaugaaaacguaaaugauaaauguaaauucacccuaccaccacucaaaauacacgagugcaauauuucaugucccaacccauuaccauuuagagaauaucgaccaauaucucaaggaguuucagacuuaguaggacuaccuaaccaaauaugcuuacaaaaaacaacuucaacaauauuaaaaccacgccucauaucauacacacucccaauaaauacaagagaaggaguaugcauaaccgauccccuacuugcaguugacaacggcuucuucgcuuacucccacuuagaaaaaauagguucuugcacaagaggaauagccaaacaaagaauaauaggaguaggagaaguccuagacagaggagacaaaguaccaucaauguucaugacaaauguauggaccccaccaaacccaucuacaauacaccauugcucaucaaccuaccacgaagauuucuauuacacacuaugcgcaguaagccacguuggugaccccauacuaaacucaacuucauggacagaaucccuaagucuaauaagauuagcaguccgaccaaaauccgacucaggugauuauaaccaaaaauauauagcuaucacaaaaguagagcgaggaaaauacgauaaaguaaugccauauggaccauccggaauaaaacaaggcgauacacucuauuucccagcuguaggcuuccuaccacgcacagaauuucaauacaacgacucaaauuguccaauaauccacugcaaauacagcaaagcagaaaauugcagauuaaguaugggaguaaacaguaaaucacauuacauacuaagaucaggauuacuaaaauacaaccuaucucucggaggagacauaauauuacaauuuaucgaaauagcagacaaccgauuaacaaucggcucaccuuccaaaaucuacaacucacuaggucaaccaguauuuuaccaagcaaguuacucaugggacacaaugauaaaacuuggagacguagacacagucgauccccuacgcguacaauggagaaacaauucuguaauauccagacccggacaaucacaauguccacgauuuaacguaugucccgaaguaugcugggaaggaacauauaacgacgccuucuuaauagaccgacuaaacuggguaucugccggcguauaccuaaacucaaaccaaacagcagagaacccuguauuugccguauucaaagacaacgaaauacucuaccaaguaccauuagcagaagaugacacaaaugcacaaaaaacaauaacagacugcuuccuacuagaaaacgucauuuggugcauaucacuaguagaaauauacgacacaggagacagcguaauccgaccaaaacuuuuugcagucaaaauacccgcucaaugcuccgaaucauaa

SEQ ID NO: 774 - RNA, 1605 nt, Artificial Sequence
  derived and/or modified CDS sequence (opt6) from Hendra henipavirus__AEB21225__G(70-604) (solG)
caaaacuacacaagaacaacugacaaccaagcacugauuaaggaauccuuacaaucaguacaacaacaaauaaaagcacuaacagauaaaauuggaaccgaaauaggcccaaaaguaucacuuauugacacuucauccacaaucacaauaccagcaaacauaggacuccuaggcucuaaaauaucucaaucaaccuccuccauaaacgaaaauguaaacgauaaauguaaguucacacuacccccuuuaaaaauacacgaaugcaauauaucauguccaaacccacuuccauuccgagaauacagaccuauaucacaaggaguaucagaucuaguaggauuaccaaaccaaauaugucuccaaaaaacuacauccacaaucuuaaaacccagauuaaucucuuauacauuaccaauaaauacaagagaaggcgucugcauaacagaucccuuacuagcugucgacaacggcuucuucgcauauucacaucuagaaaaaauaggaagcugcaccagaggaaucgccaaacaacgaauaauaggaguaggcgaaguucuagaccgaggcgacaaaguuccaucaauguucaugaccaacguauggacccccccaaaccccucaacaauacaccauugcucaucaacuuaucacgaagacuucuacuacacccuaugcgcaguaucacacguaggagacccaauacuaaacucaacaagcuggaccgaaagucucucacuaauuagacuugcaguaagaccaaaaagcgauuccggcgauuacaaucaaaaauauauagcaauaacaaaagucgaacgaggaaaguacgauaaaguaaugccauacggaccaucaggcauaaaacaaggagauaccuuauauuucccagcagucggcuuuuuaccuagaaccgaauuccaauacaacgacucuaacugcccuauaauucacuguaaauauuccaaagcagaaaacugucgauuauccaugggagucaacuccaaaucacacuauauucuaagaaguggacuauuaaaauacaacuuaucacuuggaggagacaucaccuuacaauuuauagaaauagcagauaauagacucacaauagguagcccuuccaaaauauacaauucacuaggccaaccagucuuuuaucaagcaucauacucaugggauacaaugauaaaacuaggcgacguagacacaguagacccuuuaagaguccaauggagaaauaacucaguaauaucacgacccggccaaucccaaugcccacgauucaacguuuguccggaaguauguugggaaggcacuuacaacgacgcauuccuaaucgauagacucaacuggguaucugcugguguauacuuaaauuccaaucaaacagcagaaaauccaguauucgcagucuuuaaagacaacgaaauacuauaucaaguuccccucgcugaagacgacaccaacgcacaaaaaaccauaacagacuguuuuuuauuagaaaacguaauauggugcaucucuuuaguagaaauauacgauacaggagacucaguaauacguccaaaauuauucgcagucaaaaucccagcucaaugcuccgaaucauaa

SEQ ID NO: 775 - RNA, 1605 nt, Artificial Sequence
  derived and/or modified CDS sequence (opt6) from Hendra henipavirus__AEB21216__G(70-604) (solG)
caaaacuacacacgcacaaccgauaaccaagcacuaauaaaagaaucauuacaaucaguccaacaacaaaucaaagcccucaccgauaaaaucggcacagaaauaggccccaaaguuucacucauagauacaucuaguaccauaaccaucccagcaaacaucggucuauuaggaucaaaaauaucacaaucaacauccucaauaaaugaaaaugucaacgauaaaugcaaauucacauuaccaccauuaaaaauccacgaaugcaacauaucaugucccaacccacucccuuucagagaauaccgcccaauaucccaaggagucucagacuuagucggauuaccaaaccaaaucugccuacaaaaaaccacaucuacaauacuaaaaccaagauuaaucucuuacacauuaccaauaaauacccgagaaggagucugcauuacugaccccuuacuagcuguagacaacggcuuuuuugcauacagccacuuagaaaaaaucgguuccugcacuagaggaauagcaaaacaaagaaucauaggaguaggcgaaguacuagaucgaggcgauaaaguaccaucaauguuuaugacaaaugucuggacacccccaaacccauccaccauccaccauugcucaucaacauaucacgaagacuucuauuacacacuuugcgcaguaagccacguaggugaccccauucuuaauucaacaucuuggacagaaucccuuucacucaucagacuagcaguaagaccaaaauccgacucaggagacuauaaccaaaaguauauagccauaaacaaagucgaaagaggaaaauacgauaaaguaaugccauauggcccauccggcauaaaacaaggagacacccuauauuuuccagccguaggcuuccuaccucgcacagaauuccaauauaacgauuccaacugcccaauaauacauugcaaauauucaaaagcagaaaacugcagacuaucaaugggaguaaacucgaaaucacacuacauccuuagaucaggccucuuaaaauacaaucuaucccuaggcggagacaucauauuacaauuuauugaaauagcagacaauagacuaacaauaggaucaccaucaaaaauauacaacucucuaggccaaccaguauucuaucaagcaucuuauucaugggauaccaugaucaaacuaggugaugucgauacuguugaucccuuacgaguucaauggagaaacaacuccguuauaucacgucccggucaaucacaaugucccagauucaaugucugcccugaaguauguugggaaggcacauauaacgaugccuucuuaauagaucgacuaaauuggguaucagcaggcguauaucuaaacucaaaccaaacagcagaaaacccaguauuugcaguuuucaaagacaaugaaauacucuaccaaguaccauuagcagaagaugacacaaaugcacaaaaaacuauaacagacuguuucuuauuagaaaacguaauaugguguauaaguuuaguagaaauauacgacaccggagacucuguaauaagacccaaacucuuugcaguaaaaauaccagcccaaugcucugaaucauaa

SEQ ID NO: 776 - RNA, 1605 nt, Artificial Sequence
  derived and/or modified CDS sequence (opt6) from Hendra henipavirus__AEB21206__G(70-604) (solG)
caaaacuacacacgcacaaccgacaaccaagcacuaauaaaagaaagucuacaaucuguccaacaacaaauaaaagcacuaacugauaaaauuggaacagaaauaggccccaaaguaucucuaaucgacacaucaucaacaauaacaauaccagccaacauaggacuauuaggcucaaaaaucagccaaucaaccagcaguauaaaugaaaaugucaaugacaaaugcaaauucacauuaccaccucuaaaaauacacgaaugcaacaucucaugcccaaacccacuaccauuuagagaauacagaccaauaucccaaggaguaucugaccuaguaggccuaccuaaccaaauaugucuacaaaagacaacaucaacaauuuuaaaaccaagacuaauauccuacacauuaccaauuaacacaagagaaggcgucugcauaacagauccacuauuagccgucgacaauggauucuucgcauacagccaccucgagaaaauaggcucaugcacaagaggaauagccaaacaacgcauaauaggaguaggugaaguauuagaccgaggagacaaaguaccaagcauguuuaugacaaacguauggacuccuccaaacccaucaacaauacaccacuguucaaguacauaccaugaagacuuuuacuacaccuuaugugcaguaucacacgugggagaccccauacucaauucuacuucauggacagaaucacuaucucuaauaagauuagcaguaagaccaaaauccgacucuggaaacuauaaccaaaaauacauagcaauuacaaaaguagaaagagguaaauacgacaaaguaaugccauauggaccaucagguaucaaacaaggcgauacucuauacuucccagcagucggauuucuuccaagaacagaauuucaauacaaugacaguaacuguccaauuauacauuguaaauacucaaaagcagaaaauuguagacucucaaugggagucaacaguaaaucccacuacauauuacguucaggacuucuaaaauauaacuuaucauuaggcggcgacauaauccuacaauucauagaaauagccgacaacagacuuacaauaggaucaccaagcaaaauuuauaacucauuaggucaaccuguauucuaccaagcaucauacuccugggacacuaugauuaaauuaggagacauagacaccguagacccacuuagaguacaauggaggaacaacucuguaauauccagaccuggacaaagccaaugucccagauucaauguaugucccgaagucuguugggaaggaacguacaaugacgcauuccuaauagaccgccuaaacuggguaucagcuggaguauaccuaaacucaaaucaaaccgcagaaaaccccguauucgcaguauucaaagauaaugaaauauuauaccaaguaccucuagcagaagacgacacaaacgcacaaaagaccauaaccgacugcuuccugcuagaaaaugucaucuggugcaucagcuuagucgaaauauacgauacaggagacagcguaauacgacccaaacuauuugcagucaaaauaccagcacaaugcucugaauccuaa

SEQ ID NO: 777 - RNA, 1605 nt, Artificial Sequence
  derived and/or modified CDS sequence (opt6) from Hendra henipavirus__AEQ38052__G(70-604) (solG)
caaaacuauacucgaaccacagacaaucaagcccuuauaaaagaaucacuacaaucaguacaacaacagaucaaagcauuaacagauaaaauaggaacagaaauaggaccaaaaguaucucuaaucgacacaucaucaacaaucacuauaccagcaaacaucggauuacuaggaucaaaaaucucccaaucaaccucauccauaaacgaaaauguaaacgauaaaugcaaauuuacauuaccaccccucaaaauacacgaaugcaacauaucuugcccuaaccccuuacccuuccgcgaauaucgccccauaucacaagguguuucugauuuaguaggauuacccaaucaaauaugucuacaaaaaacaacaucaacaauucuaaaaccaagauuaaucucauacacacuuccaauaaauaccagagaaggaguaugcauaacagauccacuacucgccguagauaacggcuucuuugcauauucacaucuagaaaaaauaggaucauguacccguggaauagcuaaacaaagaauaauuggcgucggagaaguacuagauagaggagacaaagucccuuccauguucaugacaaauguauggacuccaccaaacccaucaacaauacaccauugcuccucuaccuaccacgaagacuuuuacuacaccuuaugcgcagucucccauguaggcgacccaauacugaacucaacaucauggacagaaucacuaucucuuauacgauuagccgucagacccaaaucugacucaggagauuauaaucaaaaauacauaacaauaacaaaaguugaaagaggaaaauacgauaaagucaugcccuacggaccauccggaauaaaacaaggagacacacuauauuucccagcaguaggcuucuuacccagaaccgaauuucaauacaacgacucaaauugcccaauaauccacuguaaauauucaaaagcugaaaauugccgauuaagcaugggaguaaauaguaaaucacacuacauauuaagaucaggacuucuaaaauacaaccuaucauuaggaggcgacauaauauuacaauuuauagaaauagcagacaaccgcuuaacaaucggaucaccaaguaaaauauacaacucacuagggcaaccaguuuuuuaccaagcaucauacucaugggacacaaugauaaaacuaggagauguagauacaguagaccccuuaagaguacaauggagaaacaacucaguuauaucucgaccaggacaaucacaaugcccuagauucaauguaugcccagaaguauguugggaaggaacauauaacgacgcauuuuuaauagaucgccuaaauuggguuucagcuggcguauacuuaaacucaaaucaaacagcugaaaaccccguauuugccguauucaaagacaaugaaauauuauaucaaguaccucuagcagaagacgauaccaaugcacaaaaaaccauuaccgacuguuuucuacucgaaaacguaaucuggugcauaucauuaguugaaauauacgauacaggcgacucagucauaaggcccaaauuauucgcaguaaaaauaccagcucaaugcuccgaaagcuaa

SEQ ID NO: 778 - RNA, 1605 nt, Artificial Sequence
  derived and/or modified CDS sequence (opt6) from Hendra henipavirus__AEQ38115__G(70-604) (solG)
caaaacuacacaagaacaacugacaaccaagcccuaauaaaagaaucccuacaaucaguacaacagcaaauaaaagcauuaacagacaaaauaggaacagaaauaggaccaaaaguuagucuaauugacacgucaaguacaauaacaauuccagcaaauauaggucuauuaggaucuaaaauaucucaaucuaccucuucaauaaacgaaaacguaaacgauaaaugcaaauucacuuuaccuccacuuaaaauccacgaaugcaacauaucaugucccaacccccuacccuucagggaauacagaccuauaucacaaggaguaagugaucuaguaggccuaccaaaccaaauaugucuucaaaaaacuaccucaacaauccucaaaccacgacuaauauccuauacauuaccaauuaacacucgcgaaggaguauguauaacagacccacuucuagcaguagacaacggauucuucgcauacucucacuuagaaaaaauaggauccuguaccagaggaauagccaaacaaagaauaauaggaguaggcgaaguuuuagauagaggagauaaaguaccuuccauguucaugacaaauguauggacaccacccaacccaagcacaauacaucacugcucaagcacauaucaugaagacuucuacuacaccuuaugcgcaguaucucauguaggcgacccuauacuaaacuccacuucauggacagaaucacuaagccuaaucagacucgcuguacgaccuaaaucagauaacggagacuauaaccaaaaauauaucgcgaucaccaaagucgaaagaggaaaauacgauaaaguuaugccuuacggacccucuggaauaaaacaaggagacacacuauacuucccagcaguaggcuuucucccccgaaccgaauuccaauacaaugauucuaauugcccuaucauacauugcaaauacuccaaagcagaaaacuguagguuauccaugggaguaaauucuaaaucccacuauauccucagaucaggcuuacuaaaauacaacuuaucacuagguggcgauauuauauuacaauucauagaaauugcagacaacagauuaacuauuggaucacccucaaaaauauauaauucacucggacaaccaguauucuaccaagcaucguacucaugggacaccaugauaaaauuaggcgacgucgauacaguagacccacuaagaguacaauggagaaauaauuccgucauaucacgaccaggccaaucucaauguccaagauucaauguauguccagaagucugcugggaagguacauacaacgacgcuuuccuaauagauagauuaaacuggguaucagcaggagucuaccuaaacagcaaccaaacagcugaaaauccuguauucgcaguauuuaaagacaacgaaauacuauaccaaguaccacuagcagaagaugacacaaaugcacaaaaaacuauaacagacuguuuccuacuagaaaacguaauaugguguaucucacucgucgaaauauacgacacaggagacagcguaauaagaccaaaacuauuugccguaaaaaucccagcacaaugcucagaauccuaa

SEQ ID NO: 779 - RNA, 1605 nt, Artificial Sequence
  derived and/or modified CDS sequence (opt6) from Hendra henipavirus__AEQ38108__G(70-604) (solG)
caaaacuauaccagaacaacugacaaucaagcacuaauaaaagaaucacuacaaucuguacaacaacaaauaaaagcacuaacagauaaaaucggaacagaaauaggucccaaaguaagucuaauugauacaucaucuacuauuaccauucccgcuaacauaggacuacuaggaucuaaaaucucacaauccacgucaucuauaaacgaaaauguaaaugacaaauguaaauucacccuaccaccacucaaaauucacgaauguaauauaucauguccuaacccacuuccauucagagaauauagacccauaucccaaggaguauccgaccuuguaggauuacccaaucaaauaugccuccaaaaaacaacgucaacaauacuaaaaccacgauuaauaucuuacacacuacccauaaacacacgagaaggaguaugcauaacagauccccuauuagcugucgacaauggauuuuucgcuuacucucaccuagaaaaaauagguucuugcacaagaggcaucgcaaaacaaagaauaaucgguguaggagaaguccucgacagaggagauaaaguaccaucaauguucaugacuaauguuuggacuccaccaaacccauccaccauacaccauugcuccagcacauaucaugaagacuuuuacuauacacuaugugccguaucacacguaggagaucccaucuuaaacagcacaagcuggacagaaucacuaucacucauaagacuagcaguuagacccaaaucagauucaggugacuauaaucaaaaauacauaacaauaaccaaagucgaaagaggaaaauacgauaaaguaaugccauacgggcccucagguauaaaacaaggcaacacauuauauuucccagcaguaggauuuuuaccaagaacagaauuucaauacaacgacucaaacugucccaucauacacuguaaauauuccaaagcagaaaauugcagacuaagcaugggaguaaacuccaaaagccacuacauacucagaucaggacuacuaaaauacaaccuaucacucggaggugauauaauccuacaauuuauugaaauagccgacaaccgucuaacaaucggaucaccaucaaaaaucuacaacucacuaggacaacccguauucuaucaagcuagcuauucaugggacacaaugauaaaauuaggagacguagacacagucgacccccuacgaguccaauggcgaaacaacucagucauaucaaggccuggacaaucgcaauguccacguuuuaacguaugccccgaaguuugcugggaaggaacauacaaugacgcauuucuuaucgauagacucaauuggguauccgccggcguauacuuaaacucaaaccaaacagcagaaaacccugucuuugcaguauucaaagauaaugaaauacuuuaccaaguaccacucgcagaagacgauacaaacgcacaaaaaacaauaacagauuguuuucuacuugaaaaugucauaugguguauaucacuaguagaaaucuaugauacaggagacucaguaauuagaccuaaacuauuugcaguaaaaauaccugcacaaugcuccgaaucguaa

SEQ ID NO: 780 - RNA, 1605 nt, Artificial Sequence
  derived and/or modified CDS sequence (opt6) from Hendra henipavirus__AAV80426__G(70-604) (solG)
caaaacuacacaagaacaacagauaaccaagcucuaauaaaagaaucacuacaauccguccaacaacaaaucaaagccuuaacugauaaaaucggaacagaaauaggacccaaaguauccuuaauagacacuucaucaacaauaacuauaccagcuaacauaggacuauuaggcagcaaaauuucucaaugcacaucuucuaucaaugagaacguaaaugacaaaugcaaauucacccuuccuccauuaaaaauucacgaaugcaacauaucgugucccaauccacucccauuuagagaauaucgaccaauaucccaaggcguaucagaucuaguaggccucccaaaccaaauuugccuacaaaaaacaacaucuacaauacuaaaaccccgcuuaauaagcuauacucuaccaauaaacacacgcgaaggcguaugcaucacugauccccugcucgcaguagauaacggguucuucgcauauagccaccuugaaaaaauaggaucauguacuagaggaauagcaaaacaaagaauaauaggaguaggagaaguccucgauagaggagauaaagugcccagcauguucaugacaaacguauggacaccaccaaacccuucaacaauccaccacuguucaucaacauaccaugaagacuucuauuauacacuaugcgcaguaucucacguaggagacccaauauuaaacuccacaagcuggacagaaucacuaucccucauaagacuugcuguaagacccaaaucugacuccggagacuacaaccaaaaauacauagcaauaacaaaaguagaaagaggaaaauacgauaaagucaugccauacggaccaaguggaauaaaacaaggagacacacuauacuucccagcuguaggauuccucccccgaacagaauuucaauacaacgauucuaacuguccaauaauacacugcaaauauuccaaagcugaaaacugccgauuaucaauggggguuaacucaaaaucacacuacauacuaagaucaggacuacuaaaauacaaccuaucacucggcggagacauaauacuccaauuuauugaaauagccgacaaucgacuaacaauaggaucaccaaguaaaaucuacaacucacuaggucaaccagucuucuaucaagccuccuacucaugggacaccaugauaaaacuaggagauguagacaccguagauccauuacgcguacaauggagaaauaacuccgucaucagucgacccggacaaucacaauguccacgauuuaauguaugcccagaaguauguugggaaggcucauauaaugaugcauuccuaauagacagacuuaauuggguaucagcaggaguauaccuaaauucaaaccaaacagcagaaaacccuguauuugccguauucaaagacaaugaaauuuuauaucaaguuccacuagcagaagacgacaccaacgcacaaaaaacaaucacugacugcuuucuacuagaaaacguuaucugguguauaaguuuaguagaaaucuaugauacaggagacucaguaauaagacccaaacuauucgccgucaaaaucccagcacaaugcucagaaagcuaa

SEQ ID NO: 781 - RNA, 1563 nt, Artificial Sequence
  derived and/or modified CDS sequence (opt11) from Nipah henipavirus__AAK50553__F(27-546) (FdelSS)
auccuccauuacgaaaaacuaucaaaaaucggccucgucaaaggcguaacccgcaaauacaagauaaaaucaaacccgcuaaccaaagacaucguuaucaaaaugaucccaaacgucuccaacaugucccaaugcaccggcuccgucauggaaaacuacaaaacccgccuaaacggaauccucaccccaaucaaaggagcacucgaaauuuauaaaaauaacacccacgaccuagucggcgacguccgccuagcaggcguaaucauggcaggcgucgccaucggcauagccaccgccgcacagaucaccgccggugucgcccucuacgaagcaaugaaaaacgcugacaacaucaacaaacucaaauccuccaucgaauccacaaacgaagccgucguaaaacuacaagaaaccgccgagaaaaccgucuacguacucacagcccuccaagacuacauaaacaccaaccuaguacccaccauagacaaaaucuccuguaagcaaaccgaacuuagccuagaccucgcccucucuaaguaccucucagaccuccucuucguauuugguccuaaucuacaagacccgguauccaacucaaugacaauccaggccaucucccaagccuucggcggcaacuacgaaacccuccuacgcacccucggcuacgcaaccgaagacuuugacgaccuccuagaauccgacuccaucacaggccagaucauuuacgucgaccucucauccuacuacaucauaguaagagucuacuuccccauccucaccgagauccaacaagccuacauacaagaacuccuaccggucuccuucaacaacgacaauuccgaguggaucagcauaguccccaacuucauccucguacgaaacacccucaucagcaacaucgagauuggcuucugccucauaaccaaacgcuccgucaucugcaaccaagacuacgcaacccccaugaccaacaacaugcgugaaugccucacaggcagcaccgaaaaaugccccagagagcucguagucuccucccacgucccacgauucgcccuauccaacggcguccucuucgcaaacugcauuuccguuaccugccaaugccaaaccacaggacgggccaucucgcagucuggcgaacagacccuacuaaugaucgacaacacaaccugccccaccgccgucuuaggcaacgucaucaucucccugggaaaauaccucggcuccguuaacuacaacuccgaaggcaucgcaaucggaccucccgucuucaccgauaaagucgacaucuccagccaaaucuccuccaugaaucaaucucuccaacaaucaaaagauuacauaaaagaagcccaacgacuccucgacaccguaaaccccucacucaucagcauguuaucaaugaucauucuguacguacucuccaucgcgucccuaugcauaggccugaucaccuucaucucauucauaaucgucgaaaagaaacguaacaccuacucccgccuagaagaccgccgcguacgccccaccuccucuggggaccucuacuacaucgguaccuaa

SEQ ID NO: 782 - RNA, 1563 nt, Artificial Sequence
  derived and/or modified CDS sequence (opt11) from Nipah henipavirus__AEZ01388__F(27-546) (FdelSS)
auacuucacuacgaaaaacuguccaaaaucggccuugucaaagguaucacccguaaauacaaaauaaaaucaaacccccucaccaaagauaucgucauaaaaaugauccccaacgucucgaacaugucccaauguaccggcuccgucauggaaaacuacaagacccgccucaacgguauccuaaccccaauaaaaggcgcccuagaaaucuacaaaaacaacacccacgaccucgucggcgacguacgccucgccggcgucaucauggccggcguagccaucgggaucgccacagcagcccaaaucaccgccggcguugcccucuacgaagcaaugaaaaacgccgacaacaucaacaagcucaaaagcucaaucgaauccaccaacgaggccguagucaagcuccaggaaacagccgagaaaacugucuacguccuaaccgcacuccaagacuauauaaauaccaaccuaguaccaaccaucgacaaaaucagcugcaaacagacagaacugucccucgaccuagcccucagcaaauaccugagcgaccuacucuuuguauucggacccaaccugcaggaccccguuucaaacucaaugacaauacaagccaucucccaagccuucggcgggaacuacgaaacacuacugagaacccucggguacgccaccgaagacuucgacgaccuuuuagaauccgauagcauaaccggacaaaucaucuacguugaccuaagcggcuacuacauaauaguccgcguuuacuucccaauacucacagaaauucaacaagccuacauacaagaacuacucccaguguccuucaacaacgacaacuccgaauggaucuccauaguccccaacuucauccucgucaggaauacacuaaucagcaacauagagaucggcuucugccuaaucaccaaacguagcguaaucugcaaccaagacuacgccaccccuaugacuaacaacaugcgcgaaugccucaccgguucaaccgaaaagugcccacgagagcucgucgucuccucccacgugccccgcuucgcccucagcaacggcguccucuucgcaaacugcaucuccgugacaugccaaugccagacaaccggccgagccauuagccagucaggcgagcagacccuccucaugaucgacaacacaaccugcccaaccgccguccugggcaacgucauaauaucacugggcaaauaccucggaucugucaacuacaacucugaaggaauagccauaggcccacccguauucaccgauaaaguagacaucagcucccaaaucuccagcaugaaccaaagccuccaacaauccaaagacuacauuaaagaagcacaacgccuccucgacaccgucaaccccucauuaaucucaaugcucuccaugaucauccuauacguacugagcaucgccucccucugcaucggacuaaucaccuuuaucuccuucaucaucgucgaaaagaaacgcaacaccuacucgcgccuagaagaccgccgcguccgccccaccuccuccggugaccuguacuacaucggcaccuga

SEQ ID NO: 783 - RNA, 1563 nt, Artificial Sequence
  derived and/or modified CDS sequence (opt11) from Nipah henipavirus__AAY43915__F(27-546) (FdelSS)
auccuacacuacgaaaaacucuccaaaauaggccuaguuaaaggcaucacucgcaaauacaagauuaaauccaacccccucacaaaagacaucgucaucaaaaugauccccaaugucuccaacaugucccaaugcaccggcuccgucauggaaaacuacaaaacucgccucaacggaaucuuaacccccaucaaaggcgcgcucgagaucuacaaaaauaacacccacgaccugguaggcgacguccgacuugcuggagucauaauggccggcguagccaucggcaucgcaaccgcggcccaaaucaccgcagggguugcccucuacgaggccaugaaaaacgccgacaacauaaacaaacuaaaauccagcaucgaauccacuaacgaagccguaguaaaacuccaggaaacggccgagaaaaccgucuacguacuuacagcccuucaagauuacauaaauacgaaccucguccccaccaucgacaagaucucaugcaaacaaaccgaacucucccuugacuuagcgcucuccaaauacuccagcgaccuacucuucguauucgggccuaaccuccaagacccaguaagcaacuccaugaccauucaagcaauaucacaagccuucgggggcaacuaugaaacccuacucagaacccucggcuacgccaccgaaggcuucgacgaccuucuagaaucagacucuaucacuggccagauaaucuaugucgaccuaagcggauacuauauuauuguucgcgucuacuuccccauccucaccgaaauccagcaagccuacauacaggaacuccuccccgucagcuucaacaacgacaacuccgaauggaucuccaucguccccaacuucauccucguucgcaacacccuaauaucaaacaucgaaaucggcuucugccuaaucaccaaacgcuccgucauaugcaaccaggacuacgccaccccaaugaccaacaacaugcgcgaaugccucacaggcuccaccgagaaaugcccacgcgagcuaguugucuccucacacgucccccgcuucgcauuaucaaacggcguacucuucgcaaauugcaucuccgucacaugccaaugccaaaccacaggccgugccauaucacaaucaggcgaacaaacccuucucaugaucgacaauacaaccugccccaccgccguacucgguaaugucaucaucucacugggcaaauaccuaggaucagucaacuacaacucagaaggcaucgccaucggcccacccgucuucaccgauaaagucgacaucuccucucaaaucuccuccaugaaccaaucacuccaacagagcaaagacuacaucaaagaagcacaacgacuccucgacaccgucaaccccucccuaauauccaugcucucgaugaucauccucuacguacucuccauagccagccucugcaucggccuaaucaccuucaucagcuucauaauaguagaaaagaaacgcaacacauauucccgacuggaagacagacgcguccgucccacauccucaggagaccuguacuacaucggaaccuaa

SEQ ID NO: 784 - RNA, 1563 nt, Artificial Sequence
  derived and/or modified CDS sequence (opt11) from Nipah henipavirus__CAF25496__F(27-546) (FdelSS)
auccuacacuaugaaaaacuaagcaaaauaggacucguaaaaggagucacccgcaaauacaaaauuaaaucuaacccacucacaaaagacauagucaucaagaugauccccaacgucuccaacaugucccaaugcaccggcucugucauggaaaacuacaagacccgacuaaacggcauccucaccccaauaaaaggcgcccuagaaauauauaaaaacaacacccacgaccuagucggcgauguucgacucgccggcgucaucauggccggcguagccaucggcaucgccacggcagcccaaaucaccgccggcgucgcccuauacgaagccaugaaaaacgccgacaacauaaacaagcucaagagcucgaucgaaucaacaaacgaagccgucgugaaacuacaagaaacagcagaaaagacaguauacguccucaccgcccuacaagacuacaucaacaccaaccuggucccaaccauagauaaaaucucaugcaaacaaacagaacucucacucgaccucgcccuaucuaaguaccuaucagaccuccucuucgucuucggccccaaccuacaagacccagucuccaacuccaugaccauccaagccauuucccaagccuucggcggcaacuacgaaacacuacuaagaacccucggcuacgcgaucgaagacuucgacgacuuacucgaaucagacuccaucaccggccaaaucaucuacgucgaccucuccucuuacuacaucaucguacgcgucuacuucccaauccucacagaaauccaacaggccuacauccaggaacuacuccccgucuccuucaacaacgacaacuccgaauggaucuccaucgucccgaacuucauccuaguccgcaacacucucauuuccaacauagaaaucggcuucugccucaucaccaagcgcucagucaucugcaaccaagacuaugcaacacccaugaccaacaacaugcgugaaugccucaccgguuccaccgaaaaauguccccgugaacucgucguaagcucccacgucccccgcuuugcccuauccaacggcguacucuucgccaacugcaucucaguaaccugccaaugccaaaccacgggucgagcaaucucacaaucaggcgaacaaacacuccuaaugaucgacaacacaaccugcccgaccgccgucuuaggaaacguaauaaucucacucggaaaguaccucgguuccgucaauuauaacucagaaggcaucgcuauaggucccccaguauuuaccgacaaggucgacauaaguagccaaaucuccuccaugaaccaaucccuacaacaauccaaagacuacauaaaggaagcccagcgacugcuagacaccgucaacccaucgcuaaucuccaugcuguccaugaucauccuauacguccugucaaucgccucucugugcaucggccucaucaccuucauaucuuucaucaucgucgagaaaaagcgaaacaccuacucacgacucgaagaccgacgcguccgcccuaccuccucgggugaucuuuacuacauaggcaccuga

SEQ ID NO: 785 - RNA, 1563 nt, Artificial Sequence
  derived and/or modified CDS sequence (opt11) from Nipah henipavirus__AAM13405__F(27-546) (FdelSS)
auacuacacuacgaaaaacucucaaaaaucggccuugucaaaggcgucacccgaaaauacaagaucaaauccaacccccucaccaaggacauugucauaaaaaugauacccaacgucuccaacaugagccaaugcaccggaagcgucauggaaaauuacaaaacacgucucaacgguauccucaccccgaucaaaggggcccuagagaucuacaagaacaacacacacgaccucgucggugauguacgacucgcaggcgucaucauggccggcgucgccaucgggaucgccaccgccgcccaaaucaccgcuggcgucgcucuuuaugaagccaugaaaaaugccgauaacaucaacaaacuuaaauccucuauugaauccaccaacgaggccgucgucaaacuccaagaaacagcugagaaaaccguguauguccucaccgcccuccaagacuacaucaacacaaaucucgucccuacaauagacaagaucucaugcaaacaaacagaacucucucuagaccuagcccucuccaaauaccuuagcgaccuacuauucguauucggacccaaccuccaagaccccgucuccaacucaaugacaauacaagccaucagccaggccuucggcggcaacuacgaaacacuccuucgcacccucggcuacgcuacagaagacuucgacgaccuacucgaauccgacucaaucaccggccaaaucaucuauguggaccucuccuccuacuacaucaucguccgcguauacuuuccaauccuaaccgaaauccaacaggccuauauacaagaacuccucccgguuuccuucaacaaugacaacuccgaauggauauccaucgucccaaacuucauccucguccgcaacacccuaaucagcaacaucgaaaucggcuucugccuuauaaccaaacgauccguuaucugcaaccaagacuacgccaccccaacaaccaacaacaugagagaaugccucaccggcuccaccgaaaaaugccccagagaacucgucguauccucccacguaccacgguucgcacuaucaaacggcguucuauucgccaacugcaucuccguaaccugccaaugccaaaccaccggccgcgcaauaucucaauccggcgaacaaacccuacuuaugaucgacaacacaaccugccccaccgccguccuaggcaacgucauaaucucccucggcaaauaccuaggcucagucaacuacaacagcgaaggcaucgccaucggaccucccgucuucacagacaaagucgacauauccucccaaaucuccaguaugaaccaaagccuacagcaaucaaaagacuacaucaaagaagcacaacgccuccucgacaccgucaaccccucccucauaucaaugcucucaaugaucauccucuacguccuuuccaucgccucccucugcaucggccuuaucaccuucauaucauuuaucaucgucgaaaagaaaagaaacaccuacucccgccucgaagaccgcagaguccgccccaccucgucaggcgaccucuauuauaucggcacauaa

SEQ ID NO: 786 - RNA, 1563 nt, Artificial Sequence
  derived and/or modified CDS sequence (opt11) from Nipah henipavirus__CBM41033__F(27-546) (FdelSS)
auccuccacuacgaaaaacucucaaaaauaggccuuguuaaaggcguaacccgcaaauacaaaaucaaauccaauccacugacaaaagacaucgucauaaaaaugaucgccaacguguccaacaugucucaaugcacaggcuccgucauggaaaacuacaaaacccgcuuaaacgguaucuuaaccccaaucaaaggagcacucgaaaucuacaaaaacaacacccacgaccuagucggcgacguccgacucgcuggcgucauaauggccggggucgcaaucggcaucgccaccgccgcccagauaaccgccggcgucgcacucuacgaagcaaugaaaaaugccgacaauaucaacaagcuaaaaucuagcaucgaauccaccaacgaagccgucgucaaacugcaagaaaccgccgagaaaaccgucuacguucucacagcccuacaagacuacaucaacaccaaccucguucccaccauagacaaaauaucgugcaaacaaaccgaacucucccucgaccucgcacuuuccaaauaccucucagaccuucucuucguguucggcccaaaccuccaagacccagucuccaacuccaugaccauacaagccauaucacaagccuucggaggcaacuacgaaacacuacuacgcacacucggcuacgccaccgaagacuucgacgaccuccuugaauccgacucgauuacaggccaaaucaucuacgucgaccuaagcagcuacuacauaaucguccgcgucuacuuccccauccucaccgaaauccaacaagccuacauccaagaacugcuccccgucagcuucaacaacgacaacucagaauggaucucuauuguaccuaauuucauccucguccgcaacacccucaucuccaauaucgaaauagguuucugccuaaucacuaaacgauccgucaucugcaaucaagacuacgccacccccaugacaaacaacaugagggaaugccucaccgggucaaccgagaaaugcccccgcgaacucgucgucuccucccacgucccucgauucgcgcucuccaacggaguccuauucgcaaacugcaucucuguaaccugccaaugccaaaccaccggacgcgcaaucucacaauccggugaacaaacucuccuaaugaucgauaacacaaccugccccaccgcuguacucggcaaugucauuauaucccuuggcaaauaccuaggaucggucaauuacaacuccgagggcauugccaucggcccucccguauucaccgacaaagucgacaucuccucccaaaagucauccaugaaccaaucucugcaacaauccaaagacuacaucaaggaagcccaacgccuccuagacaccgucaaccccucccucaucucaaugcucuccaugaucaucuuauacguacuaucuaucgccucccucugcaucggucucauuaccuucaucucuuucaucaucgucgaaaagaaacgaaacaccuacucacgccucgaagaccgccgcgugcgccccaccuccagcggagaccuuuacuacaucggcaccuaa

SEQ ID NO: 787 - RNA, 1563 nt, Artificial Sequence
  derived and/or modified CDS sequence (opt11) from Nipah henipavirus__AEZ01396__F(27-546) (FdelSS)
auacuccacuacgaaaaacuuuccaaaaucgggcucgucaaagggaucacgcggaaauacaaaaucaaaucgaacccgcucaccaaagacauaguaauaaaaaugauuccaaacgucucaaacaugucccaaugcaccggcucagucauggagaacuacaaaacccgacucaacggaauacuaaccccaaucaaaggcgcccucgaaaucuacaaaaacaacacacacgaccuaguuggcgacguacgacucgcaggcguaauuauggccggcgucgcaauaggcauugccaccgccgcccaaaucaccgccggaguagcacuauacgaagccaugaagaacgccgacaacaucaauaaacucaaaucuucaaucgaaagcaccaacgaagcagucgugaaacuacaagaaaccgcagagaaaaccgucuacguucuuaccgcacuacaagauuacauaaacaccaaccucguuccaacaaucgacaaaaucucaugcaaacagacugaacuaagccucgaccucgcucucucaaaauaccucuccgaccuccuauucgucuucggccccaaccuccaagaccccguaagcaacuccaugacaauccaagcaaucucucaagccuucggcggcaacuacgaaacccuucuccgcacucuaggcuacgccaccgaagacuuugacgaccuacuagaauccgacucgaucaccggacaaaucaucuacgucgaucucuccggcuacuacauuauaguuagggucuacuucccaauacuuaccgaaauccaacaagcauacauccaggaacuccuccccgucucuuucaacaacgacaacucggaauggauaagcaucguccccaacuucauccucguccguaacacccucauaucaaacaucgaaaucggcuucugccuaauuacuaaacgcuccgucaucugcaaccaagacuacgccaccccaaugacaaacaacaugcgcgaaugccucaccggcucaaccgaaaaaugcccgagagaacucgucgucucaucucacgucccacgcuucgcgcuauccaacggcguacuuuuugccaacugcauuuccguuacaugccagugccaaacuaccgguagagcaaucucccaaagcggagaacaaacccuccucaugaucgacaacaccacaugccccaccgccguccucggaaacgucaucaucagccucggcaaauaccucggcuccgucaacuacaauucagaaggcaucgccauaggcccucccguauucaccgacaaagucgacaucuccucccagaucucauccaugaaucaaucgcuucagcaauccaaagauuacaucaaggaagcccaacgccuccucgacaccgucaaccccucccucaucucaaugcucucaaugaucauccuauacguccucucaaucgccagccucugcaucggccuaauaaccuucaucucauucauuauaguagaaaagaaacgcaacaccuacuccagacuagaggaccgccgagucagacccaccucauccggagaccucuacuacaucggaaccuaa

SEQ ID NO: 788 - RNA, 1563 nt, Artificial Sequence
  derived and/or modified CDS sequence (opt11) from Hendra henipavirus__NP_047111__F(27-546) (FdelSS)
auccuccauuacgaaaaacuaucaaaaaucggacuuguaaaaggcaucaccagaaaauacaaaauaaaauccaacccucucaccaaagauauugucaucaaaaugauccccaacguauccaacgucuccaaaugcacgggaacagucauggaaaacuacaaaagcagacuaaccggcauccucucaccgaucaagggcgcaaucgaacucuacaacaacaacacccacgaccucgucggcgacguuaaacucgccggcguagucauggccggcaucgcaaucggcauagccacggccgcccaaaucaccgccggagucgcacuuuacgaagcaaugaaaaacgccgacaacauaaacaagcuaaaauccuccaucgaaagcacaaacgaagccgucgugaaacuccaagaaaccgccgagaaaaccgucuacguucuaaccgcccuucaagacuacaucaacaccaaccucguccccacaauugaccaaauuucaugcaaacaaacagaacucgcccuagaccuagcccucagcaaauaccucuccgaccuccucuucgucuucggccccaaccuucaagacccuguauccaacagcaugacuauacaggccaucucccaagcauucggcggcaacuacgaaacccuacuccgcacccucggguacgccacagaagauuucgacgaccuccucgaauccgacagcaucgccggccaaauaguuuacguagaccuguccuccuacuacaucaucguacgcgucuacuucccaauccuaaccgaaauucaacaagccuacguacaagaacuccuacccgucucauucaacaacgacaacuccgaauggaucucaaucgucccaaacuucguccucauacgaaacacacugaucuccaacaucgaagucaaauacugccucaucacaaagaaaagcgucaucugcaaccaagacuacgccacacccaugaccgccuccguccgagaaugccuaacagguuccaccgacaaaugcccccgcgaauuagucgucuccagccacguccccagguuugcacucuccggcggcguccuauucgccaacuguaucuccguuaccugccaaugccagacuaccggcagagccaucucccaauccggagaacaaaccuuacucaugauugacaacacaaccugcaccaccgucguccuagguaacaucaucaucucccucgggaaauaccuaggcuccaucaacuacaacuccgaauccauugcggucggaccucccgucuacaccgacaaaguagacaucuccucccaaaucagcuccaugaaccaaucccuccaacaaucuaaagacuacauaaaagaagcccagaaaauccucgacaccgucaaccccucccucauuuccaugcucuccaugaucauccucuacguucuauccauagccgcccucugcauuggccuaaucaccuucaucuccuucguuaucgucgaaaagaaacgcggaaacuacucucgucucgacgaccgccaaguccgccccgucagcaauggcgaccuuuacuacaucggaaccuag

SEQ ID NO: 789 - RNA, 1563 nt, Artificial Sequence
  derived and/or modified CDS sequence (opt11) from Hendra henipavirus__AEB21233__F(27-546) (FdelSS)
auccuccacuacgaaaaacucuccaaaauaggccucguuaaaggcauuacccggaaauacaaaaucaaaucgaacccccucaccaaagacaucgucaucaaaaugaucccuaacguaucaaacgucuccaaaugcaccgguaccgucauggaaaacuacaaaucccgacucaccgguauccucagcccuauuaaaggagccaucgaacuauacaacaauaacacccacgaccucgucggcgaugucaaacuggcaggcguugucauggccggaaucgccaucggcaucgcuacagccgcacaaauaaccgccggcguagcucuauacgaggccaugaagaacgccgauaacaucaacaaacuaaaaucauccauagaauccaccaaugaagccguagucaaacuccaagaaaccgcagaaaagaccguuuacguccucaccgcacuccaagacuacauuaacaccaaccuuguccccaccaucgaccaaauuuccugcaaacaaaccgaacucgcacucgaccucgcacucuccaaguaccuauccgaccuccuguucguauucggccccaaccuccaagaccccguauccaacuccaugaccauccaagccaucucccaagccuucggcggcaacuacgaaacccugcuacgaacgcucggcuacgcaaccgaagacuucgacgaucuccucgaauccgacuccaucaccgggcaaaucgucuacgucgaccugucauccuacuacaucauaguacgaguauacuuccccauccucaccgaaauccaacaagccuauguccaagaacuccuccccgucucuuuuaacaacgacaacagcgaauggaucucgaucguccccaacuucguccucauacgcaacacucuaauauccaauaucgaaguaaaauacugccucauaacaaagaaauccgucaucugcaaccaagauuacgccacaccuaugaccgccuccguacgagaaugccucaccggcucaaccgacaaaugcccccgugaacucgucguauccagccacguaccacgcuucgcccucucaggcggaguacuguucgcuaacugcaucucuguaacaugccaaugccaaacaaccggacgcgccaucucccaaucaggcgaacaaaccuugcucaugauugacaauaccacgugcacuacagucguucuaggaaacaucaucaucagccucggaaaauaccucggcuccaucaacuacaacucugaguccauugccgucgggccacccgucuacaccgacaaagucgacaucuccucucaaaucucauccaugaaccaaucccuacaacaguccaaagacuauaucaaagaagcccagaaaauccucgacaccgugaaccccucacuaaucucaaugcuaucuaugaucauccucuacguccuauccaucgcugcccucugcaucggccucauaaccuucaucagcuucguaauuguagaaaagaaacgcggcaacuacucacggcuagacgaccgccaaguccgacccguaucaaacggcgaccucuacuacauaggcaccuaa

SEQ ID NO: 790 - RNA, 1566 nt, Artificial Sequence
  derived and/or modified CDS sequence (opt11) from Hendra henipavirus__AEQ38114__F(26-546) (FdelSS)
ggaauccuccacuacgaaaaacucucaaaaauugggcucgucaaaggcaucacccgaaaauacaaaaucaaauccaacccucucaccaaagacaucgucaucaaaaugauccccaacgucagcaacgucuccaaaugcaccggcacagucauggaaaacuacaaaucccgccucaccggaauacuaucuccuaucaaaggcgccaucgagcucuauaacaacaacacccacgaccucgucggcgaugucaaacuagccgggguuguaauggccggcauagccaucggcaucgcaaccgcugcacaaaucaccgccggugucgcccucuaugaagccaugaaaaacgccgacaacauaaacaaacuaaaaucuucaaucgaguccaccaacgaagccgucguaaaacuccaagaaaccgccgaaaaaaccguuuacguccucaccgcccugcaagacuacaucaacacaaaccucguacccaccaucgaucaaaucucaugcaaacaaaccgaacucgcucucgaccucgcccucuccaaauaccuuuccgaccuccucuucguauucggccccaaccugcaagaccccgucuccaacucaaugaccauucaagccauaucacaagccuucgggggcaacuacgaaacacuccuccgcacccucggcuacgcaaccgaagacuucgacgaccuacucgaauccgauucaaucacaggccaaauaguauacgucgaccuguccucauacuacaucaucguccgcgucuacuucccaauccucaccgagauccaacaagcauacguccaggagcuccuaccugucucuuucaacaaugacaacucagaauggauaucgauaguccccaacuucguccuuauccgcaacacacucaucagcaacaucgaagucaaauacugccuaaucaccaaaaaaucgguaaucugcaaccaagacuacgccacccccaugaccgccucaguucgagagugccuaacaggcuccacagacaaaugccccagagagcucgucguaucaucccacguaccucgcuucgcccuuuccggcggcguccuuuucgccaacugcaucuccgucaccugccaaugccaaacaaccggucgcgcgaucucacaaucgggcgaacaaacccuucuuaugauugacaacacaaccugcacaaccgucguacucggcaacaucaucaucucgcucggaaaauaccuaggcuccaucaacuacaacagcgaaagcaucgcugucggcccccccgucuacaccgacaaaguagacauuuccucccaaaucuccuccaugaaccaaucccuccaacaaagcaaagacuacaucaaagaagcccaaaaaauuuuagauaccgucaaccccucccucaucucaaugcuaucaaugauaauccuguacguacuguccaucgccgcccucugcaucggucucaucaccuucaucucauucauaauaguagaaaaaaaacgcggcaacuacucucgucucgacgaccgccaaguccgccccgucucaaacggugaccucuacuacaucggcacauga

SEQ ID NO: 791 - RNA, 1563 nt, Artificial Sequence
  derived and/or modified CDS sequence (opt11) from Hendra henipavirus__AAB39505__F(27-546) (FdelSS)
auccuccacuacgaaaaacuuuccaaaaucggccucgucaaaggcaucacccgaaaauacaaaaucaaaagcaacccccuuacaaaagauaucgugaucaaaaugaucccuaacgucuccaaugucucaaaaugcaccggaaccgucauggaaaacuacaaaucccgccuuaccggaauacucucccccaucaaaggcgcaaucgaacucuacaacaacaacacacaugaccucgucggugacguaaagcucgccggcguggucauggccggcauagccaucgguaucgcaacagccgcccaaaucacagccggaguagcacucuacgaagccaugaagaacgcagacaacaucaacaaacuaaagucaaguaucgaauccaccaacgaagcuguugugaaacuccaagaaaccgcagagaaaaccgucuacguccucacagcacuccaagacuacaucaacaccaaccuuguccccaccaucgaccaaaucuccugcaaacaaacugaacuagcccucgaccucgcccucuccaaauaccuccucaucugcucaugcuucggccccaaccuacaagaccccguuuccaacagcaugaccauccaagcuauaucccaagcauucggcggaaacuacgaaacccuacuucguacacucggcuacgccacagaagacuucgacgaccuccucgagucagacuccaucaccggccaaaucgucuacgucgaccucucuuccuacuacaucaucguacgcguauacuuccccauccugacagaaauacaacaagcauacguccaagaacuucuccccguuuccuucaacaacgacaacucagaauggaucagcaucguuccaaacuucguacucauacgcaacacccucaucuccaacauagaagucaaauacugccuaaucaccaagaaauccgucauuuguaaccaggacuacgccaccccaaugaccgcgucaguccgagaaugccucaccggaucuaccgacaaaugcccccgagaacucguugucuccagccacgucccgcgcuucgcccuauccggaggaguacuauucgccaacuguauaucaguaaccugccaaugccaaacuaccggccgcgcaaucucccaaucgcgcgagcaaacccuccucaugaucgacaacacaaccugcacaaccgucguccucggcaacauaauuauaucucucccaaaauaucuaggaucuaucaaacugcagguacuccgagcccuucugcuaggccaccaauccauacagaccaaaguugauauauccagccaaaucuccucaaugaaccagucccugcaacaauccaaagacuacauaaaagaagcccagaaaauccuagacaccgucaacccaucccucauauccaugcucucaaugaucauccucuacguccucuccaucgccgcgcugugcaucggacucaucacuuucaucagcuucgucaucgucgaaaagaaacgcggcaacuacucccgccuugacgaccggcaaguacggcccgucucaaacggcgaccuauacuacaucggaacguaa

SEQ ID NO: 792 - RNA, 1599 nt, Artificial Sequence
  derived and/or modified CDS sequence (opt11) from Nipah henipavirus__AAK50554__G(70-602) (solG)
caaaacuacacccgaucaacugacaaccaagccgucaucaaagacgcacuccaagguauccaacaacaaaucaaaggccucgccgacaaaauuggaaccgaaaucggccccaaagucagccucaucgacaccucaucaaccauaaccauacccgccaacauugggcuccucggcuccaaaauuucccagagcaccgccucaaucaacgaaaacgucaacgaaaaaugcaaguucacccucccaccccucaaaauccacgaaugcaacaucuccugccccaacccccuccccuuucgggaauaccgaccccaaaccgaaggcgucucuaaccucgucggccucccgaacaacaucugccuccagaaaacguccaaccaaauccucaaaccaaaacuuaucuccuacacccucccggucguaggccaaagcggaaccuguauuaccgacccccuccucgcaauggacgaaggcuauuuugcauacucccaccucgaacgaaucggaucaugcagccgaggcguauccaaacaacgaaucaucggcguuggcgaaguacuagaccgaggcgacgaggucccaucccucuuuaugacuaacgucuggacuccucccaaccccaacaccgucuaccacugcuccgccguauacaacaacgaguucuacuacguccucugcgcagucagcacagucggugaccccauccuaaacuccaccuacuggucaggcucacucaugaugacuagacuagccguaaaacccaaauccaacggcggaggcuacaaccaacaucaacucgcccuccgaagcaucgaaaaggguagauacgacaaagucaugcccuacggccccuccggcaucaagcaaggcgauacccucuacuuuccagccgucggauuccucguccgcaccgaguucaaauacaacgacucuaauugccccaucaccaaaugucaauacucaaagcccgaaaacugccgccucuccaugggcauccgucccaacucccacuacauccuccgauccggccuucuuaaguacaaccucucugacggagaaaaccccaaaguaguauucaucgaaaucucagaccaacgccucagcaucggcuccccauccaaaaucuacgacucccucggacaacccgucuucuaccaagcaaguuucucaugggacacaaugaucaaguucggggacguccugacaguaaacccccuagucgucaacuggagaaauaacaccgugaucucacgccccggccaaucccaaugcccccgcuucaauaccugccccgaaaucugcugggaaggugucuacaacgacgcuuuccuuauagaccgcaucaacuggaucuccgcaggaguguuccucgacuccaaccaaaccgccgaaaaccccguguuuacaguauucaaagacaacgaaauccucuaccgcgcccaacuagccuccgaggacacuaacgcgcagaaaaccaucaccaacugcuuccuccucaaaaacaagauauggugcaucucccuaguugaaaucuacgacacuggcgacaacgucauccgaccuaagcuguucgcaguuaaaaucccagaacaaugcaccuaa

SEQ ID NO: 793 - RNA, 1599 nt, Artificial Sequence
  derived and/or modified CDS sequence (opt11) from Nipah henipavirus__AEZ01389__G(70-602) (solG)
caaaacuacaccagaucaaccgacaaccaagcaaugaucaaagacgcccuccaaagcauccaacaacaaauuaaaggccucgccgacaaaaucggaacugagaucggccccaaaguuucccucauugacaccuccucaacaaucaccaucccagcgaacaucggacuacugggcuccaaaaucucacaauccacagccuccauaaacgagaacgucaacgaaaaaugcaaguucacacucccgccacuaaaaauacacgaaugcaacauauccugccccaacccccuccccuuccgcgaauacaaaccccaaaccgaaggcgucucgaaccucgucgggcuaccaaacaacaucugccuccaaaagaccucgaaccaaauacucaagcccaaacuuaucagcuacacccuccccguagucggccaaagcggaaccugcaucaccgacccccuccucgccauggacgagggcuacuucgcauauucccaccuagagaaaaucggcuccugcagccgcggcguaucgaaacaacgaauaauaggaguaggagaaguacucgaccgaggcgacgaagugcccucccuuuucaugaccaacguguggacacccucaaaccccaacacagucuaccacugcagcgcggucuacaacaacgaguucuacuacguccuaugcgcagucucaguagucggagaccccauacuaaacucuaccuacugguccggcucccucaugaugacccgccucgccguaaagccgaaaaacaacggcgaauccuacaaccaacaccaauucgcucuccgaaacaucgaaaaagguaaauaugacaaagucaugcccuacggucccuccgguaucaaacaaggcgacacccucuacuucccagccgucggcuuccucguccgaaccgaguucaaauacaacgacuccaacugucccaucgccgaaugucaauauucaaaacccgaaaacugccgacucuccaugggcauccgcccaaauucucacuacauccuccgcuccggucuccucaaauacaaccuauccgaugaagaaaacucgaaaaucgucuucauugaaaucuccgaccaacgccuauccaucggcucgcccucaaagaucuacgauucccuaggccaaccggucuucuaccaagccuccuucucaugggacaccaugaucaaauucggcgacguccaaacugucaacccacucgucguaaacuggcgcgacaacaccgucaucucaagacccggacaaucccaaugcccccgcuucaacaaaugcccagaaguaugcugggaaggcgucuacaacgacgccuuccucauagaucgcauaaacuggaucucagcgggaguuuuccuggacuccaaucaaacagcagaaaaccccguauucacugucuucaaagacaacgaaguucuauaucgugcccagcuugccuccgaagacacaaacgcacagaaaacaaucaccaacugcuuccugcucaaaaacaaaaucugguguaucucccucgucgaaauauaugacacaggcgacaacgucauacgcccaaaacuguucgccgucaaaauccccgagcaaugcaccuaa

SEQ ID NO: 794 - RNA, 1599 nt, Artificial Sequence
  derived and/or modified CDS sequence (opt11) from Nipah henipavirus__ACT32615__G(70-602) (solG)
caaaacuacacgcgcucaacugacaaccaagccaugaucaaagacgcccuacaaucgauacaacaacagaucaaaggccucgccgacaaaaucggaaccgaaaucgguccgaaagucucacuaaucgacaccucaucaaccaucacaauccccgcgaacaucggcuuacuaggcucaaaaaucucacagucaacagcaucaaucaaugaaaacgucaacgaaaaaugcaaguucacccugccuccccucaaaauccacgaaugcaacaucagcugccccaacccccuacccuuccgggaauacaagccccagacagagggcguaagcaaucuaguuggccuuccaaacaacaucugcuuacagaaaaccuccaaccaaauccuaaaacccaaacuuaucagcuacacacuccccguagucggacaaucaggaaccugcauaaccgacccccuucucgccauggacgaagguuacuucgccuacucccaccuagagaaaauaggcucaugcucacgcggagucuccaaacaacgcaucaucggagucggagaaguccuagaccgaggcgacgaaguccccagccucuucaugacgaacgucuggacaccgucgaaccccaacacaguguaccacugcagcgccguauacaacaacgaguucuacuauguccuaugcgccgucuccgucgucggagaccccguccuaaacuccaccuacugguccggcucccucaugaugaccaggcuggccguuaaacccaaaaacaacggcgaauccuacaaccaacaccaauucgcccuuagaaacaucgaaaaaggaaaauacgacaaagucaugcccuacggaccauccggaauaaaacaaggcgacacccuguacuucccagcugucggcuuccuaguucgaaccgaguucaaauacaacgauagcaacugccccaucgcugaaugucaguacuccaaaccugaaaacugccggcuauccaugggcauccgccccaacucacacuacauccuaagaucaggacuccucaaauacaaccucuccgacgaagaaaacucuaagaucgucuucauagaaaucucagaccaacgcuuaagcaucggcucuccauccaaaaucuacgacucacuaggacaacccgucuucuaccaagcauccuucucaugggacacgaugaucaaguucggcgacguacaaacagucaacccccuaguggucaacuggcgagauaacaccgucaucucucgaccuggacaaucccaaugcccacgauucaacaagugcccagaagucugcugggaaggaguauacaacgacgccuuccucauugaccguaucaacuggaucuccgcaggcgucuuccucgacucaaaccaaaccgcagaaaaccccguguuuaccgucuucaaagacaacgaaguccucuaccgcgcccaacucgcaagcgaagacaccaacgcccaaaagacaaucacaaacugcuuccuucuaaagaacaaaauauggugcaucucccuaguggaaauuuacgacaccggugacaacgucauccggcccaaacucuucgcagucaaaauccccgaacagugcaccuaa

SEQ ID NO: 795 - RNA, 1599 nt, Artificial Sequence
  derived and/or modified CDS sequence (opt11) from Nipah henipavirus__CAF25497__G(70-602) (solG)
caaaacuacacccgaucuacugacaaccaagcagucauaaaagacgccuuacaaggaauacaacaacaaaucaaaggacucgccgauaaaaucggcacugaaauaggccccaaagucagcuuaaucgacacaucauccacaaucacaauccccgccaacauaggucuacuugguuccaaaaucucccaaucaacagccucuaucaacgaaaacguaaacgaaaaaugcaaauucacccuacccccacucaaaauacacgaaugcaacaucuccugccccaacccccuccccuuccgcgaauaccgaccccaaaccgaaggcgucuccaaccucgucggccucccgaacaacauuugccuccagaaaacuagcaaucaaauccuaaaacccaaacucaucucauacacacugcccgucguaggccaaucgggaaccugcauaaccgacccccuccuagccauggacgaaggcuacuucgccuacucccaccuagaacggauuggcagcugcucccgcggcgucucaaaacaacgaauaaucggcguuggagaaguacuugaccgcggggacgaaguaccaucucuauucaugaccaacguaugggcaccaccuaacccuaacaccguauaccacugcuccgccguauacaacaacgaguucuacuacguccucugcgcagucucaaccguaggcgaccccauccucaacuccacuuacugguccggcucucucaugaugacccggcucgccgucaaacccaaauccaacggcgguggcuacaaccaacaccaacucgcucuccgauccaucgaaaaaggucgauacgacaaagucaugccguacggcccguccggcaucaagcaaggcgacacgcucuacuuccccgcagucggcuuccucguccgcaccgaguucaaauacaacgacucaaacugccccauaacaaaaugccaauacuccaaacccgaaaacugucgccucagcaugggcauccgaccaaacucgcauuacauccuacgauccggacuacuaaaguacaaccucuccgacggggaaaaccccaaaguuguuuucaucgaaaucuccgaccaacgccuuagcauaggauccccguccaagaucuacgacucgcuaggccagccagucuucuaccaagccaguuucuccugggacaccaugaucaaauucggcgacguccucaccgucaacccacuggucgucaacuggagaaacaacacugucauaucaagaccaggacaaucacaaugcccccgcuucaauaccugccccgaaauaugcugggaaggcgucuacaacgaugcauuccucaucgaccgaaucaacuggaucagcgccggcgucuuccucgacagcaaccaaacagccgaaaacccagucuucaccgucuucaaagacaacgaaauccucuaccgagcccaacuugccucagaagacaccaacgcccagaaaaccaucacaaacugcuuucuccucaaaaacaaaaucugguguaucucccuggucgaaaucuaugacacuggcgauaacgucauucgccccaaacuauucgcaguaaaaauccccgaacaaugcacauaa

SEQ ID NO: 796 - RNA, 1599 nt, Artificial Sequence
  derived and/or modified CDS sequence (opt11) from Nipah henipavirus__CBM41034__G(70-602) (solG)
caaaacuacacccgcuccaccgacaaccaagccgucauaaaagacgcacuccaaggcauccaacaacaaaucaaaggacucgccgacaaaaucggaacagaaaucggucccaaagucucucucauagacacauccucaacuauaaccauccccgccaacauaggauugcucggaucaaaaauaucgcaauccaccgccuccaucaacgaaaacgugaacgaaaaaugcaaauucacccuaccaccccuaaaaauccacgaaugcaacaucucaugccccaacccacugccauuccgcgaauaccgcccccaaacagaaggcguaucuaaucucgucggccugccagacaacaucugccuccagaagacguccaaccaaauccuaaaacccaaacucaucucauacacacuacccgucgucggccaauccgggacaugcaucacggacccccuccucgccauggacgaaggguacuucgcauacucacaccuagaacgcaucgguucaugcuccagaggcgucuccaaacagcgcaucaucggcgucggcgaaguccuggaccguggcgacgaaguacccucccuguucaugaccaacguauggaccccucccaaccccaacaccgucuaccacugcucagccgucuacaacaacgaauuuuacuacguccuuugcgcugucaguacuguaggcgauccuauccucaacucgaccuacuggucaggaucccucaugaugacgcgucuugcagucaaacccaaaucaaacggcggcggcuacaaccaacaccaacucgcccuacgcagcaucgaaaaaggccgauacgacaaagucaugccauacggucccuccggcauuaaacagggcgacacacucuacuuccccgccgucggcuuccucguuagaacagaguucaaauacaacgacucaaacugcccaauaacaaaaugccaauacucaaaacccgaaaauugccgccuauccaugggcauacgccccaacagccacuacauccuccgauccggccuacucaaauacaaccucucagacggcgaaaaccccaaaaucguauucaucgaaauauccgaccaacgacucuccaucggcucucccucgaaagucuacgacucacuaggacaaccagucuuuuaccaagcuagcuuuucaugggacaccaugaucaaguucggagacguacaaacaguuaacccucucguuguuaacuggcgcgacaacaccgucauaucccgacccggccaaucccaaugcccccgcuucaauaccugccccgaaaucugcugggaaggaguauacaacgacgccuucuuaaucgaccgaauaaacuggaucuccgccggcgucuuccucgacuccaaccaaacagccgaaaacccugucuucacuguauuuaaagacaacgaaauacuauaccgcgcccaacucgcaagcgaagacaccaacgcacagaaaacaauaaccaacugcuuccuccucaaaaauaaaauauggugcaucagccuggucgaaauuuacgacaccggagacaacgucaucagaccuaaacucuucgccgucaaaauccccgaacaauguacauga

SEQ ID NO: 797 - RNA, 1599 nt, Artificial Sequence
  derived and/or modified CDS sequence (opt11) from Nipah henipavirus__AAX51853__G(70-602) (solG)
caaaacuacacacgauccacugacaaccaagcugucauaaaagacgccuuacaaggcauccagcaacaaauuaaaggccucgcagacaaaaucggcacugaaauaggccccaaaguaucccuaauagauaccuccuccacaauaacuauaccagccaacaucggucuucuagguucuaaaaucucacaauccaccgcaagcaucaacgaaaacguaaacgaaaaaugcaaauucaccuugccaccccuaaaaauccacgaaugcaauaucuccugccccaacccccuccccuuccgagaguacagaccccaaaccgaaggcgucucgaaccucgucggccucccgaacaacauaugucuacaaaagaccucaaaccaaauccuuaaacccaaacucauaagcuacacgcuccccguagucggccaaucaggcacgugcaucacagacccccuacucgcaauggacgaaggcuacuucgccuacucucaccuggaacgcaucggcuccuguucuagaggcguauccaaacagaaaauaaucggggucggcgaaguccucgaccguggagacgaaguccccucccuauucaugacaaacguauggaccccacccaaccccaacaccgucuaccacugcuccgcaguuuacaacaacgaguucuacuacguacucugugcagucuccaccguaggcgaccccauacucaacuccaccuauuggagcggaucccuaaugaugacccggcucgccgucaaaccaaaaucaaacgacggcggcuacaaccaacaccaacucgcccuacgcucaauugaaaaaggccgauaugacaaagucaugcccuacggucccucuggcauaaaacaaggagauacacucuacuucccugcagucggcuuucucguacgcacagaguucaaauacaacgacucaaacugccccaucacuaaaugccaauacuccaaacccgaaaacugccgccucuccaugggaauccgccccaacucccacuacguccuccgauccggacuccucaaauacaaccuauccgacggcgaaaaccccaaaaucguauucaucgaaaucuccgaccaacgccuaucaauuggaucacccucaaaaaucuacgauucucucggucaacccguuuucuaccaagccucauucucgugggacaccaugauaaaguucggagacgugcaaaccgucaacccacucgucguauccuggcgagacaacacagucauaucccgcccgggacaaucccaauguccccgcuucaauacaugccccgaaaucugcugggaaggcgucuacaacgacgcauuccucaucgaccgaaucaacuggaucuccgccggcgucuuccuagacucgaaccaaaccgcagaaaaccccgucuucaccgucuuuaaagacaacgaaauccucuaccgcgcgcaacuagccuccgaagacacaaacgcccagaaaaccauaaccaacugcuuccuccucaaaaacaaaaucuggugcaucucacucgucgaaaucuacgacaccggcgacaacguuauccgccccaagcuauucgccguuaaaaucccagagcaaugcacauga

SEQ ID NO: 798 - RNA, 1599 nt, Artificial Sequence
  derived and/or modified CDS sequence (opt11) from Nipah henipavirus__AEZ01397__G(70-602) (solG)
caaaacuacacccgaagcaccgacaaccaagccaugauaaaagaugcccuucaauccauccaacaacaaaucaaaggccucgcagacaaaauagggaccgaaaucggacccaaagucucccuaaucgacaccuccucaaccaucacuauccccgcaaacaucggccuccuaggauccaaaaucucacaauccaccgcaagcauaaacgaaaacgucaacgaaaaaugcaaauucacccuaccaccccuaaaaauucacgaaugcaacaucucaugccccaauccccuaccauuccgcgaauacaaaccucaaaccgaagggguaucuaaccucgucggucuccccaacaacaucugccuccagaaaaccuccaaccaaauucucaaacccaaacuaauauccuacacacuccccgucguagggcaguccggcacaugcauaacggacccccuucucgccauggacgaaggcuauuucgcauacucccaucuggagaaaaucggcuccugcagccgcggcgucucgaaacaacgaaucaucggcguaggagaaguccucgaccgcggcgacgaagugccaagucucuucaugacaaacgucuggacccccuccaacccaaacaccgucuaccacugcuccgccguauacaauaacgaguucuacuacguccuaugcgcagugucugucgucggagacccgauucuaaacuccaccuacuggagcggcucacucaugaugacccgacucgcagucaaacccaaaaacaacggagaauccuacaaccaacaccaauucgccuuacguaacauagaaaaaggaaaauaugacaaggucaugccauacggccccuccggaaucaaacaaggcgacacccuauauuucccggccgucggauuucuaguccgcacugaguucacauacaacgacaguaacugccccauagccgaaugccaauauagcaaacccgaaaacugccgauuauccaugggaauccgacccaacucccacuacauccuccgcucagggcuccucaaauacaaccugagcgacgaagaaaacuccaaaaucgucuucaucgaaauauccgaccaacgccuaagcaucggcucacccagcaagauauaugacucccucggccaacccgucuucuaccaagcaucauucuccugggacaccaugauaaaauucggcgacguucaaacgguaaacccacucguaguuaacuggcgcgacaacacagucaucagccgccccggccaaucccaaugcccccgauuuaauaaaugccccgaagugugcugggaaggagucuacaacgacgccuuccugauagaccgcaucaacuggaucagcgcaggcgucuuccucgacuccaaccaaaccgccgaaaaccccgucuucacagucuucaaagacaacgaaguccuauaccgcgcacaacucgccucagaggacaccaacgcccagaaaaccaucaccaacugcuuccuucucaaaaacaaaauauggugcaucagccucgucgagaucuaugacacaggcgacaacgucauccgccccaaauuauucgccguaaaaaucccugaacaaugcacauaa

SEQ ID NO: 799 - RNA, 1605 nt, Artificial Sequence
  derived and/or modified CDS sequence (opt11) from Hendra henipavirus__NP_047112__G(70-604) (solG)
caaaacuacacucgaacaacagacaaccaagcacuaauaaaagagucacuccaguccguccaacaacaaaucaaagcacuaacagacaaaauaggaaccgagaucggucccaaagucucccuuaucgacacauccuccaccauuaccaucccagccaauauuggccuacuuggcuccaaaaucucccaaucaaccucaucaauaaacgaaaacgucaacgacaaaugcaaauucacccucccaccccuaaaaauccacgagugcaacaucuccugccccaacccacuucccuuccgcgaauaccgucccaucucccaaggcgucuccgaccuuguaggccucccuaaccaaaucugccuacagaaaaccacaagcaccauacucaaaccccgacuaaucucauacacccuaccuaucaacacacgagagggcgucugcaucaccgauccacuacuagcuguugacaacggcuuuuucgccuacucccaccucgagaaaaucggaucaugcacucgcggcauagccaaacaacgcaucaucggcgucggagaaguccucgaccgaggcgacaagguucccuccauguucaugaccaacguuuggacacccccuaaucccucaaccauccaccacugcuccucaaccuaccacgaagacuuuuacuacacccucugcgcagucucccacgucggcgaccccauacuaaacuccaccuccuggacagaaucccucucccucauccgucuggccguccgccccaaaucagacagcggagacuacaaccaaaaguacaucgcgauaaccaaagucgaacgcggcaaguacgacaaaguaaugcccuacggccccuccggcaucaaacaaggagacacucuauacuucccagcaguaggcuuccuaccccggacugaguuccaauacaacgacucaaacugccccaucauacacugcaaauacucaaaagcagaaaacugccggcucagcaugggggucaacucuaaaagccacuacauacuccgauccggauuacucaaauacaaccuaucccuaggcggcgacauaauccuccaguucauugaaaucgcugacaaccgccuuaccaucggcagcccaucaaaaauauacaacucucuaggacaacccgucuucuaccaagccuccuacuccugggacaccaugaucaaauuaggagacgucgacaccguagacccgcuccgcguacaguggcguaacaacucugucaucucccgccccggacagucucaaugcccccgcuucaaugucugccccgaaguaugcugggaaggcacguacaacgacgcauuccucaucgaccgccuuaacugggucucagcaggcguauaccucaacuccaaccaaacugccgaaaaccccguuuucgccguuuucaaggacaacgaaauccuauaccaagucccccucgccgaagacgacaccaacgcccagaaaacaaucacggacugcuuccuccuagaaaacguaaucuggugcaucagcuuagucgagaucuacgacacaggcgauucagucauacgccccaaacuauucgcuguuaagauccccgcccaaugcuccgaaaguuag

SEQ ID NO: 800 - RNA, 1605 nt, Artificial Sequence
  derived and/or modified CDS sequence (opt11) from Hendra henipavirus__AEB21225__G(70-604) (solG)
cagaacuacacaaggaccaccgacaaccaagcccucauaaaggaaagccuacaauccguccaacaacaaaucaaagcacucaccgacaagaucggcaccgaaaucggacccaaggucucacuaaucgauaccucauccacaauaaccauaccagccaacaucgggcuacucggcucaaaaaucucccaguccacaagcuccauuaacgaaaacgucaacgacaaaugcaaguucacacucccgccccucaaaauccacgaaugcaacauauccugccccaacccccuccccuuccgugaauaccgcccgaucucucaaggugucucagaccucguaggccuccccaaccagaucugccuccaaaagacgaccucaacaauccucaaaccacgccuaaucuccuacacccuccccaucaacacccgagaaggagucugcaucaccgacccacuacucgccgucgauaacggcuucuuugccuacucacaccucgaaaagaucggauccugcacgcgcggcaucgcaaaacagcgcauaaucggcgucggcgaaguccucgaccgcggcgacaaagucccuagcauguucaugaccaacguauggaccccacccaaccccuccaccauccaccacugcagcaguacauaccacgaagacuucuacuacacccucugcgcugucucccacgugggagacccaauccucaauuccaccucauggaccgaaucgcucucccucauccggcuagccguucgccccaaauccgacuccggagacuacaaccagaaauacaucgcaauaacgaaagucgaaagaggcaaguacgacaaagucaugccguacggccccuccggaaucaaacaaggagacacccucuacuucccggccguaggauuccucccccgaaccgaauuucaauacaacgacucaaacugcccaauuauacacugcaaauacuccaaagccgaaaacugcagacuaucaaugggagucaacuccaaaucucacuacauacuccgcuccggacuccucaaauacaaccucucccugggcggcgacaucacacuccaauucaucgaaaucgccgacaaccgccucaccaucggcagccccucaaaaauauacaacucccucggacagcccgucuucuaccaggccuccuacucgugggauacaaugauaaaacucggcgacgucgacaccgucgacccccuucgaguccaauggcguaacaacucagucaucuccagacccggccaaagccaaugcccaagauucaacgucugccccgaaguaugcugggaaggaacauacaacgacgccuuccuuaucgaccgccucaacugggucucugccggcguauacuuaaacagcaaucaaaccgccgagaacccagucuucgcagucuuuaaagauaacgaaauccuauaccaagucccacucgcagaagacgacacaaacgcccagaaaacgaucacagacuguuuccuacuagaaaacgucaucuggugcaucagucucgucgaaauauacgacaccggcgacagcguaauacgccccaaacuuuucgccguaaagauccccgcucaauguucugaaucuuag

SEQ ID NO: 801 - RNA, 1605 nt, Artificial Sequence
  derived and/or modified CDS sequence (opt11) from Hendra henipavirus__AEB21216__G(70-604) (solG)
caaaacuacacacgcaccacagacaaccaagcccuaaucaaagaaagccuacaaucuguacaacagcaaaucaaagcacuaacagacaaaauuggcaccgaaauuggccccaaagucucccucaucgauacauccucaaccaucacaauacccgccaacaucggccuucucggcucuaaaauaucccaaagcaccuccucuaucaacgaaaacguaaacgacaagugcaaguucacacuaccaccccucaaaauccaugaaugcaauauaucaugccccaacccccuccccuuuagagaguaccgcccaaucucccaaggcgucuccgaccuggucgggcuaccaaaccaaaucugccuccagaaaacaaccuccaccauacuaaaaccccgccuuaucagcuacacccuacccaucaacacacgagagggcgucugcaucaccgacccccuccucgccgucgauaacggcuucuucgccuacagucaccucgaaaagaucggaagcugcaccagaggcaucgccaaacaacgcaucaucggcgucggagaaguucuugaccgcggcgauaaaguacccagcauguucaugacaaacgucuggacaccacccaacccaucaaccauccaccauugcuccucgacuuaccacgaagacuucuacuacacccuaugcgcgguuucccacguaggagaccccauccuuaacuccacgucuuggaccgaaucacucucccucauccgacuggccguacgccccaaaucugacuccggcgacuacaaccaaaaauauauugcaaucaacaaagucgaaagaggaaaauacgacaaagucaugccuuauggcccaagcggcaucaaacaaggagacacacucuacuuccccgccgucggcuuccucccccggaccgaguuccaauacaacgacuccaacugcccgauaauccacugcaaauacagcaaagcugaaaacugcagacuguccaugggagucaacuccaaaagccacuacauccuccgcuccgggcugcucaaauacaaccuaucccuugggggcgacaucauccuccaauucaucgaaauagcugacaacagacucacaauaggaucccccuccaaaaucuacaacucccucggucagccagucuucuaccaagccuccuacuccugggacacgaugaucaaacuaggugacgucgacacagucgacccccuacgaguccaauggcgaaacaacuccgucauaucccgccccggccaaagccaaugcccacguuucaacgucugccccgagguauguugggaaggcaccuacaacgacgcauuccucauagaccgacucaacugggucuccgccggcguauaccucaacagcaaccaaacugccgaaaaccccgucuuugccgucuuuaaggacaacgaaauccucuaccaagucccccucgccgaggaugacacuaacgcccagaaaaccauaaccgacuguuuucuucucgagaacgucaucuggugcaucagccucgucgagaucuacgacaccggcgacuccgucauacgacccaaacucuucgcagucaaaaucccagcacaaugcucugaguccuag

SEQ ID NO: 802 - RNA, 1605 nt, Artificial Sequence
  derived and/or modified CDS sequence (opt11) from Hendra henipavirus__AEB21206__G(70-604) (solG)
caaaacuacacccgaaccaccgacaaucaagcacucaucaaagaaucccuccaauccguccaacaacaaauaaaagcacuuacggacaagaucggaaccgaaauuggccccaaagucagccucaucgacacgagcuccacgauaaccauccccgccaacaucggccuccucggauccaaaauuucccaauccaccuccucaauaaacgaaaacguaaacgauaaauguaaauucacccuacccccauuaaaaauccacgaaugcaacauaucaugcccuaacccacuccccuuucgagaauaucgacccauaagccaaggugucagcgaccuaguaggccuccccaaccaaauaugccuccagaaaaccacauccaccauccuaaaaccacgccucauaucuuacacccuacccauaaacacucgagaaggggucugcauaaccgacccacuccucgccgucgacaacggguucuucgccuacucccaccuugagaaaaucggaagcugcacacgcggcauagcaaagcaaagaauaaucggcgucggagaaguacucgaccgcggcgacaaaguccccuccauguucaugaccaacgucuggaccccaccaaaccccuccaccauccaccacugcuccuccaccuaccacgaggacuucuacuacacacucugcgcaguaucacaugugggcgaccccauccucaacuccacauccuggaccgaaagccucucccucauccggcuugccguacguccuaaauccgacagcggaaacuacaaccaaaaguacaucgcaaucacaaaagucgagcggggcaaauacgacaaagucaugccauacggacccuccggcauaaaacaaggagacacccuauacuuccccgccgucggauuccuaccccgcaccgaguuccaauacaacgacuccaacugccccaucauacacuguaaauacucgaaagccgaaaacugccgccucuccaugggagucaacucuaaaucccacuacauccuccgcuccggccuccugaaauacaaccuaagccucgggggcgacaucauccuacaauucaucgaaaucgcggacaaccgacucacaauaggcucacccaguaaaauauacaacagccucggccaaccugucuucuaccaagccucauacuccugggacaccaugauaaaacucggcgacaucgacacagucgacccacugcgcguccaauggcgaaacaacuccguuaucucccguccuggacaaucucaaugcccccgauucaacguaugcccagaagucugcugggaaggaaccuacaacgacgccuuccuuauugaccgacucaacugggucucugcgggcguauaccuuaacuccaaccagaccgccgaaaaccccguauucgcagucuucaaagauaacgaaauccuauaccaagucccccucgccgaagaugacaccaacgcccagaaaacaaucaccgacugcuuccuccucgaaaacguaaucuggugcaucucccucguugaaauauacgacaccggcgacuccguaauacgacccaaacuauucgcugucaaaauccccgcacaaugcucagaauccuaa

SEQ ID NO: 803 - RNA, 1605 nt, Artificial Sequence
  derived and/or modified CDS sequence (opt11) from Hendra henipavirus__AEQ38052__G(70-604) (solG)
caaaacuacacacguaccacagacaaccaagcccucauuaaagaauccuuacaauccguccaacaacaaauaaaagcccucaccgacaaaauaggcacugaaaucggccccaaaguaucccucauugacaccagcuccaccaucaccaucccagccaacaucggccuacucgguucgaaaaucucccaaucgacuucauccauaaacgaaaacguaaacgauaagugcaaguucacgcuacccccacuaaaaauacacgaaugcaacauauccugcccaaacccccucccuuuccgcgaauacaggccaaucucccaaggcgucuccgaccuaguaggccuaccuaaccaaauuugccuccaaaagacaaccuccacgauccucaaaccacgccuaauauccuacacccuucccaucaacacccgcgaaggaguaugcaucacagacccacuccucgccgucgacaacggcuucuuugcauauucacaccucgagaaaaucggcucuugcacacgcggcaucgcaaaacaacgcaucaucggcgucggugaaguccuagacagaggcgacaaaguacccuccauguucaugaccaacguauggaccccgccaaaccccucgaccauacaccacuguuccuccaccuaccacgaagacuucuacuacacacucugcgcagucucccacguaggggaccccauccucaacucgacauccuggaccgaaucacuuucccuaauccgccuagcaguacggcccaaaucagacuccggcgacuacaaccaaaaauacauaacaauuaccaaagucgaacguggaaaauacgauaaaguaaugcccuacggccccuccggcauaaaacaaggcgacacacucuacuuccccgcagucggauuccucccccgaaccgaguuccaauacaacgacucaaacugccccaucauacacuguaaauacucaaaagcagaaaacugccgccucuccaugggcguaaacucaaaaucccacuacauucuccgcagcggacuacugaaguacaaccucucacucggcggcgacauuauucuucaauucauagaaaucgccgacaaccgcuuaacaauaggcucacccucaaagaucuacaauucccuuggccaacccgucuucuaccaagcauccuacuccugggacacaaugaucaaguuaggcgaugucgacacagucgacccccuccgugugcaauggcgaaacaauuccgucaucucacgcccaggccaaucccaaugcccccguuucaacgucugccccgaggucugcugggaaggcacauacaacgaugccuuccucaucgaccgucucaacugggucucagccggagucuaccuaaacuccaaccaaacugcagaaaaccccgucuucgccgucuucaaggacaacgaaauccucuaccaaguaccacuagccgaagacgacaccaacgcucagaaaaccaucacagacugcuuucugcuagaaaacgucauauggugcauuucccucgucgaaauauacgauaccggagacuccgucaucagacccaaacuguuugcagucaaaaucccagcacaaugcuccgaauccuaa

SEQ ID NO: 804 - RNA, 1605 nt, Artificial Sequence
  derived and/or modified CDS sequence (opt11) from Hendra henipavirus__AEQ38115__G(70-604) (solG)
caaaacuacacccgcacaacugacaaccaagcacucaucaaagaaucacuccaauccguccaacaacaaauaaaagcacucaccgacaaaauagguacagaaaucggccccaaagucucacuaaucgacacaucaagcaccaucacgaucccagccaacaucggccuacucggauccaaaauaucccaaucuacaaguuccaucaacgaaaacguaaacgacaagugcaaauucacccuaccaccccugaaaauacaugaaugcaacaucucaugccccaacccccuccccuuccgagaauaccgccccauuucccaaggaguauccgaccucgugggacuacccaaccaaaucugccugcagaaaacaaccuccacaauccuaaaaccccgacucauuucuuacacgcuccccaucaacacgcgagaaggcguaugcauaaccgacccccuauuagcaguugacaacggcuucuucgccuacucccaccuagagaaaaucggcucauguacccgcggcaucgccaagcaacgcauaaucggcguaggcgaaguccuggaccgaggagacaaggucccaagcauguucaugaccaacguuuggaccccacccaaccccuccaccauccaccacugcagcuccaccuaccacgaagacuucuacuacacgcuuugugccgucucucacgucggagaccccauacuuaacuccacauccuggaccgaaucgcugagccugauccgccucgcgguccgacccaaauccgacaacggcgauuacaaccaaaaauacaucgccaucaccaaaguagaacgaggcaaguacgacaaagucaugcccuacggccccuccggcaucaagcaaggcgacacccuauauuucccagccgucggauuccucccccgcacagaguuccaguacaacgacuccaacugccccaucauucacugcaaguacuccaaagcugaaaacugccggcucucaaugggcgucaacuccaaaucgcacuacauacuacguucuggccuccucaaauacaaccucagccuaggaggagacauaauacuccaauucaucgaaaucgcagacaaccgccucaccaucgggucccccucaaaaauauauaacucccucggccagccugucuucuaccaagccuccuacuccugggacaccaugaucaagcucggagacguugacaccguagacccccuccgcguacaguggcgcaacaacuccgucauaagucgccccggacaaucccaaugccccagauucaacgucugcccagaagucugcugggaaggcacguacaacgacgcauuccuuaucgaucgccuaaauugggucuccgcaggagucuaccucaacucuaaccaaaccgcagaaaaccccgucuucgccgucuucaaagacaacgaaauccucuaccaagucccccucgcugaagacgacaccaacgcacagaaaacuaucaccgauugcuuccuacucgaaaacgucaucuggugcaucucacucguagaaauauacgacaccggcgacuccgucauucgccccaaacucuucgcagucaaaaucccagcccaaugcagcgaaucuuag

SEQ ID NO: 805 - RNA, 1605 nt, Artificial Sequence
  derived and/or modified CDS sequence (opt11) from Hendra henipavirus__AEQ38108__G(70-604) (solG)
caaaacuacacacgaacaaccgacaaccaagcccucauuaaggaaucccuccaaucaguccaacaacaaaucaaagcgcuuacugacaagaucggcaccgaaauaggccccaaagucucccuaauugacaccucaucuacaauaaccauccccgccaacaucggccuccuagggucaaaaaucucucaauccacauccagcauaaacgagaacgucaacgacaagugcaaguucacccuaccaccccucaaaauacacgagugcaacauaagcugccccaacccccuccccuuccgagaguaccgccccauaucacagggagucucagaccucguaggacuacccaaccaaaucugccuucagaaaaccacuuccacuauccuuaaaccccgccucaucuccuauacccuaccuaucaacacccgcgaaggcgucugcaucacggacccccuacuagcagucgacaacggcuucuucgcauacucccaucuugagaaaauaggaagcuguacccgaggcauagccaaacaacgcaucaucggcguuggcgaaguccuagaccgcggcgacaaaguccccucuauguucaugaccaacgucuggacucccccaaaccccucaaccauccaccacugcuccucaaccuaccacgaagacuucuacuacacccuaugcgcagucucucacgucggggacccuauacucaacuccacuucauggaccgaaagccucucccuaauccgccuagccgucaggcccaaauccgacucaggcgacuacaaccaaaaauacaucaccaucaccaaggucgaacgaggcaaauacgacaaagucaugcccuacgggcccuccggcauaaaacaaggcaacacccuauauuuuccagccguuggcuuccuuccccgaacugaguuccaauacaaugacuccaacugcccaauaauccacugcaaauacuccaaagcagaaaacugccgacuauccaugggagucaacucgaaaucgcacuacauccuccgcucuggccucuuaaaauacaaccucucccucggcggagacaucauccuccaguucaucgaaaucgccgacaaccgucucaccaucggauccccauccaaaaucuacaauucccucggccaacccgucuuuuaucaggcauccuauuccugggacaccaugaucaaacuuggugacgucgacaccgucgacccccuacgcguacaauggcggaacaacucagucauaucacgcccaggccaaucccagugcccucgcuucaacgucugcccagaaguaugcugggaaggaaccuacaacgacgccuuccucauagaucgccucaacugggucuccgccggcgucuacuuaaacagcaaccaaacagccgaaaacccaguuuucgccgucuucaaagacaacgaaauccuguaccaaguuccacuagccgaagaugacacaaacgcucagaaaaccauuacagacugcuuucuccucgaaaacgugauauggugcauaucccucgucgaaaucuacgacacgggagacuccgucauccguccaaaacuguucgccgucaaaaucccagcccaauguuccgaauccuag

SEQ ID NO: 806 - RNA, 1605 nt, Artificial Sequence
  derived and/or modified CDS sequence (opt11) from Hendra henipavirus__AAV80426__G(70-604) (solG)
caaaauuacacccgcaccacagacaaccaagcccucauaaaagaaucccuccaaucaguccaacaacagaucaaagcccugaccgacaaaauaggcacagaaaucggacccaaagucucccuaaucgacaccucauccaccaucacuaucccggcaaacaucggccuccucggcuccaaaaucagccaaugcaccuccucaauaaacgaaaacgucaaugacaaauguaaauuuacccugccgcccuuaaaaauccacgagugcaacaucucaugccccaacccccuccccuuccgcgaauacagacccaucucccaaggcgucucggaccucgucggccuccccaaccaaaucugccuccagaaaaccaccucgaccauucucaagccccgccuaaucuccuacacacucccaauaaauacucgcgagggagucugcaucaccgacccacuacuagccgucgacaacggcuucuuugccuacucccaccuagagaaaaucggcaguugcacccgcggcaucgccaaacaacguauaaucggugucggugaaguacucgacagaggcgacaaaguccccagcauguucaugaccaacgucuggacgcccccaaaccccucaaccauccaccacugcucaucaaccuaccacgaagacuuuuacuacacccucugcgcugucucucacgucggagacccaauccucaacucaacaucauggacagaaagccucagccuaauacgccuagccguccggcccaaauccgacucaggcgacuacaaccaaaaauacauugccauaaccaaagucgaacggggaaaauacgacaaaguuaugcccuauggccccucggggaucaaacaaggagacacccucuacuuccccgcagucggcuuccucccccgcaccgaguuccaauacaacgacuccaacugccccaucauccacugcaaauacagcaaggccgaaaacugccgccuaagcaugggcguaaacuccaagucacacuacauccugcgcucaggacuacugaaauacaaccucucccucggcggagacaucauacuccaauucaucgaaaucgccgacaaccgccuaaccauaggcucccccucaaaaaucuacaacucccuaggccaacccgucuucuaccaagccuccuacucuugggacaccaugauaaaacuaggagacgucgacacugucgacccccuacgcguacaauggcguaacaacucagucaucucccgcccgggccaaagccaaugcccacgcuucaacgucugccccgaaguuugcugggaaggcuccuacaacgacgccuuccuaauagaccgucucaacugggucagcgcaggagucuaccucaacuccaaccaaaccgccgaaaacccugucuuugccguuuucaaggacaacgaaauacucuaccaggucccucucgcagaggacgacaccaacgcacagaaaaccaucaccgacugcuuccugcucgaaaacguaaucuggugcaucucccuugucgaaauauacgacaccggcgacuccgucauacguccaaaacuauucgccguaaaaaucccagcccaaugcuccgaauccuaa

SEQ ID NO: 807 - protein, 538 aa, Artificial Sequence
  derived and/or modified protein sequence (wt) from Nipah henipavirus__AAK50553__HsIgE(1-18)_F(27-546)
MDWTWILFLVAAATRVHSILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 808 - protein, 538 aa, Artificial Sequence
  derived and/or modified protein sequence (wt) from Nipah henipavirus__AEZ01388__HsIgE(1-18)_F(27-546)
MDWTWILFLVAAATRVHSILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 809 - protein, 538 aa, Artificial Sequence
  derived and/or modified protein sequence (wt) from Nipah henipavirus__AAY43915__HsIgE(1-18)_F(27-546)
MDWTWILFLVAAATRVHSILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYSSDLLFVFGPNLQDPVSNSMTIQAISQAFGGNYETLLRTLGYATEGFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 810 - protein, 538 aa, Artificial Sequence
  derived and/or modified protein sequence (wt) from Nipah henipavirus__CAF25496__HsIgE(1-18)_F(27-546)
MDWTWILFLVAAATRVHSILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYAIEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 811 - protein, 538 aa, Artificial Sequence
  derived and/or modified protein sequence (wt) from Nipah henipavirus__AAM13405__HsIgE(1-18)_F(27-546)
MDWTWILFLVAAATRVHSILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPTTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 812 - protein, 538 aa, Artificial Sequence
  derived and/or modified protein sequence (wt) from Nipah henipavirus__CBM41033__HsIgE(1-18)_F(27-546)
MDWTWILFLVAAATRVHSILHYEKLSKIGLVKGVTRKYKIKSNPLTKDIVIKMIANVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQKSSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 813 - protein, 538 aa, Artificial Sequence; identical to SEQ ID NO: 808
  derived and/or modified protein sequence (wt) from Nipah henipavirus__AEZ01396__HsIgE(1-18)_F(27-546)

SEQ ID NO: 814 - protein, 538 aa, Artificial Sequence
  derived and/or modified protein sequence (wt) from Hendra henipavirus__NP_047111__HsIgE(1-18)_F(27-546)
MDWTWILFLVAAATRVHSILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 815 - protein, 538 aa, Artificial Sequence
  derived and/or modified protein sequence (wt) from Hendra henipavirus__AEB21233__HsIgE(1-18)_F(27-546)
MDWTWILFLVAAATRVHSILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 816 - protein, 538 aa, Artificial Sequence
  derived and/or modified protein sequence (wt) from Hendra henipavirus__AEQ38114__HsIgE(1-18)_F(26-546)
MDWTWILFLVAAATRVHSILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFIIVEKKRGNYSRLDDRQVRPVSNGDLYYIGT

SEQ ID NO: 817 - protein, 538 aa, Artificial Sequence
  derived and/or modified protein sequence (wt) from Hendra henipavirus__AAB39505__HsIgE(1-18)_F(27-546)
MDWTWILFLVAAATRVHSILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLLICSCFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSREQTLLMIDNTTCTTVVLGNIIISLPKYLGSIKLQVLRALLLGHQSIQTKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 818 - protein, 550 aa, Artificial Sequence
  derived and/or modified protein sequence (wt) from Nipah henipavirus__AAK50554__HsIgE(1-18)_G(70-602)
MDWTWILFLVAAATRVHSQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 819 - protein, 550 aa, Artificial Sequence
  derived and/or modified protein sequence (wt) from Nipah henipavirus__AEZ01389__HsIgE(1-18)_G(70-602)
MDWTWILFLVAAATRVHSQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPILNSTYWSGSLMMTRLAVKPKNNGESYNQHQFALRNIEKGKYDKVMPYGPSGIKQGDTLYFPAVGFLVRTEFKYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 820 - protein, 550 aa, Artificial Sequence
  derived and/or modified protein sequence (wt) from Nipah henipavirus__ACT32615__HsIgE(1-18)_G(70-602)
MDWTWILFLVAAATRVHSQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPVLNSTYWSGSLMMTRLAVKPKNNGESYNQHQFALRNIEKGKYDKVMPYGPSGIKQGDTLYFPAVGFLVRTEFKYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 821 - protein, 550 aa, Artificial Sequence
  derived and/or modified protein sequence (wt) from Nipah henipavirus__CAF25497__HsIgE(1-18)_G(70-602)
MDWTWILFLVAAATRVHSQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWAPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 822 - protein, 550 aa, Artificial Sequence
  derived and/or modified protein sequence (wt) from Nipah henipavirus__CBM41034__HsIgE(1-18)_G(70-602)
MDWTWILFLVAAATRVHSQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPDNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKIVFIEISDQRLSIGSPSKVYDSLGQPVFYQASFSWDTMIKFGDVQTVNPLVVNWRDNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 823 - protein, 550 aa, Artificial Sequence
  derived and/or modified protein sequence (wt) from Nipah henipavirus__AAX51853__HsIgE(1-18)_G(70-602)
MDWTWILFLVAAATRVHSQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQKIIGVGEVLDRGDEVPSLFMTNVWTPPNPNTVYHCSAVYNNEFYYVLCAVSTVGDPILNSTYWSGSLMMTRLAVKPKSNDGGYNQHQLALRSIEKGRYDKVMPYGPSGIKQGDTLYFPAVGFLVRTEFKYNDSNCPITKCQYSKPENCRLSMGIRPNSHYVLRSGLLKYNLSDGENPKIVFIEISDQRLSIGSPSKIYDSLGQPVFYQASFSWDTMIKFGDVQTVNPLVVSWRDNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 824 - protein, 550 aa, Artificial Sequence
  derived and/or modified protein sequence (wt) from Nipah henipavirus__AEZ01397__HsIgE(1-18)_G(70-602)
MDWTWILFLVAAATRVHSQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPILNSTYWSGSLMMTRLAVKPKNNGESYNQHQFALRNIEKGKYDKVMPYGPSGIKQGDTLYFPAVGFLVRTEFTYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 825 - protein, 552 aa, Artificial Sequence
  derived and/or modified protein sequence (wt) from Hendra henipavirus__NP_047112__HsIgE(1-18)_G(70-604)
MDWTWILFLVAAATRVHSQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 826 - protein, 552 aa, Artificial Sequence
  derived and/or modified protein sequence (wt) from Hendra henipavirus__AEB21225__HsIgE(1-18)_G(70-604)
MDWTWILFLVAAATRVHSQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDITLQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 827 - protein, 552 aa, Artificial Sequence
  derived and/or modified protein sequence (wt) from Hendra henipavirus__AEB21216__HsIgE(1-18)_G(70-604)
MDWTWILFLVAAATRVHSQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAINKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 828 - protein, 552 aa, Artificial Sequence
  derived and/or modified protein sequence (wt) from Hendra henipavirus__AEB21206__HsIgE(1-18)_G(70-604)
MDWTWILFLVAAATRVHSQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGNYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDIDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 829 - protein, 552 aa, Artificial Sequence
  derived and/or modified protein sequence (wt) from Hendra henipavirus__AEQ38052__HsIgE(1-18)_G(70-604)
MDWTWILFLVAAATRVHSQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYITITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 830 - protein, 552 aa, Artificial Sequence
  derived and/or modified protein sequence (wt) from Hendra henipavirus__AEQ38115__HsIgE(1-18)_G(70-604)
MDWTWILFLVAAATRVHSQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDNGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 831 - protein, 552 aa, Artificial Sequence
  derived and/or modified protein sequence (wt) from Hendra henipavirus__AEQ38108__HsIgE(1-18)_G(70-604)
MDWTWILFLVAAATRVHSQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYITITKVERGKYDKVMPYGPSGIKQGNTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 832 - protein, 552 aa, Artificial Sequence
  derived and/or modified protein sequence (wt) from Hendra henipavirus__AAV80426__HsIgE(1-18)_G(70-604)
MDWTWILFLVAAATRVHSQNYTRTTDNQALIKESLQSVQQQIKALTDKIGTEIGPKVSLIDTSSTITIPANIGLLGSKISQCTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGSYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 833 - RNA, 1617 nt, Artificial Sequence
  derived and/or modified CDS sequence (wt) from Nipah henipavirus__AAK50553__HsIgE(1-18)_F(27-546)
auggacuggaccuggauccuguuccucguggccgccgcgacccgcguccacagcauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuuaguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuaugaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 834 - RNA, 1617 nt, Artificial Sequence
  derived and/or modified CDS sequence (wt) from Nipah henipavirus__AEZ01388__HsIgE(1-18)_F(27-546)
auggacuggaccuggauccuguuccucguggccgccgcgacccgcguccacagcauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacuaacugcuuugcaggauuacauuaauacuaacuugguaccgacaauugacaagauaagcugcaaacagacggaacucucauuagaucuagcacuaucaaaguaccucucugauuugcuuuuuguauuuggucccaaccuucaagacccaguuucuaauucaaugacuauacaggcuauaucucaggcauucgguggaaauuaugaaacacugcuaagaacguuggguuacgcuacagaagacuuugaugaucuucuagaaagugacagcauaacgggucaaauuaucuacguugauuuaaguggcuacuacauaauugucaggguuuauuuuccuauccugacugaaauccaacaggccuauauccaagaauuguugcccgugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcugaugauugauaacaccaccuguccuacagcuguacucgguaaugugaucaucagcuugggaaaauaucuugggucaguaaauuauaacucugaaggcauugcuauugguccuccugucuuuacugauaaaguugacauaucaagucaaauaucuagcaugaaucaguccuuacagcaaucuaaggacuauaucaaagaagcucaacgacuccuugauacuguuaacccgucauuaauaagcauguuaucuaugaucauacuguauguacuaucaauugcaucauuguguauaggguugauuacauuuaucaguuuuaucauuguugagaaaaaaagaaauaccuauagcagauuagaggacaggagggucagaccuacaagcaguggggaucucuauuacauugggacguag

SEQ ID NO: 835 - RNA, 1617 nt, Artificial Sequence
  derived and/or modified CDS sequence (wt) from Nipah henipavirus__AAY43915__HsIgE(1-18)_F(27-546)
auggacuggaccuggauccuguuccucguggccgccgcgacccgcguccacagcauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguacuccucugauuugcuuuuuguauuuggucccaaccuucaagacccaguuucuaauucaaugacuauacaggcuauaucucaggcauucgguggaaauuaugaaacacugcuaagaacguuggguuacgcuacagaaggcuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcuaaugauugauaacaccaccuguccuacagcuguacucgguaaugugaucaucagcuuggggaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 836 - RNA, 1617 nt, Artificial Sequence
  derived and/or modified CDS sequence (wt) from Nipah henipavirus__CAF25496__HsIgE(1-18)_F(27-546)
auggacuggaccuggauccuguuccucguggccgccgcgacccgcguccacagcauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcuuuacaggauuacauuaauacuaauuuaguaccgacaauugacaaaauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuauagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauuaguaaggaauacauuaauaucaaauauagagauuggauuuugccuaauuacaaagaggagcgugaucugcaaccaagauuaugccacaccuaugaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 837 - RNA, 1617 nt, Artificial Sequence
  derived and/or modified CDS sequence (wt) from Nipah henipavirus__AAM13405__HsIgE(1-18)_F(27-546)
auggacuggaccuggauccuguuccucguggccgccgcgacccgcguccacagcauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuuaguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuacgaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 838 - RNA, 1617 nt, Artificial Sequence
  derived and/or modified CDS sequence (wt) from Nipah henipavirus__CBM41033__HsIgE(1-18)_F(27-546)
auggacuggaccuggauccuguuccucguggccgccgcgacccgcguccacagcauucuacauuaugagaaauugaguaaaauuggacuugucaaaggaguaacaagaaaauacaagauuaaaagcaauccucucacaaaagacauuguuauaaaaaugauugcgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugccauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuugguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuaugaccaacaacaugagagaauguuugacgggaucgacugagaaguguccucgagagcugguuguuucaucacauguucccagauuugcacuaucuaacggaguucuguuugccaauugcauaaguguuacaugccagugucaaacaacaggcagggcaaucucacagucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagaaauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuggaggauaggagagucagaccuacaagcaguggggaucucuacuacauugggacauag

SEQ ID NO: 839 - RNA, 1617 nt, Artificial Sequence
  derived and/or modified CDS sequence (wt) from Nipah henipavirus__AEZ01396__HsIgE(1-18)_F(27-546)
auggacuggaccuggauccuguuccucguggccgccgcgacccgcguccacagcauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaacuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguaccucucugauuugcuuuuuguauuuggucccaaccuucaagacccaguuucuaauucaaugacuauacaggcuauaucucaggcauucgguggaaauuaugaaacacugcuaagaacguuggguuacgcuacagaagacuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcuggugguuucaucacacguucccagauuugcacuaucuaacgggguuuuguuugcuaauugcauaagcgucacaugccagugucaaacaacagguagggcaaucucacagucaggagaacaaacucugcugaugauugauaacaccaccuguccuacagccguacucgguaaugugaucaucagcuugggaaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 840 - RNA, 1617 nt, Artificial Sequence
  derived and/or modified CDS sequence (wt) from Hendra henipavirus__NP_047111__HsIgE(1-18)_F(27-546)
auggacuggaccuggauccuguuccucguggccgccgcgacccgcguccacagcauacuacauuaugagaaacuuaguaagauagggcugguuaaagguauuacaagaaaguacaagauuaagaguaacccuuugaccaaggauauugugaucaaaaugaucccuaaugucucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcagguguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagagcucgcauuagacuuggcguugucuaaguaucugucugaucugcucuuuguuuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauagcaggccagauagucuauguagaucucaguagcuauuacauaauaguaaggguguauuuucccauacuaacagagauccaacaggcuuaugugcaggaguugcuuccagugaguuuuaauaacgauaauucagaauggaucagcauugucccgaauuucgugcugauuaggaacacgcugauuucaaauauagaagucaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcagcacugugcauuggucugaucacuuucauaagcuuuguaauaguugagaaaaagagagggaauuacagcaggcuagaugauaggcaagugcgaccggucaguaauggugaucuguauuauauuggaacauaa

SEQ ID NO: 841 - RNA, 1617 nt, Artificial Sequence
  derived and/or modified CDS sequence (wt) from Hendra henipavirus__AEB21233__HsIgE(1-18)_F(27-546)
auggacuggaccuggauccuguuccucguggccgccgcgacccgcguccacagcauacuacauuaugagaaacuuaguaagauagggcugguuaaagguauuacaagaaaguacaagauuaagaguaacccuuugaccaaggauauuguaaucaaaaugaucccuaauguuucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcaggcguggugauggcagggauugcaaucgggauagcuacugcugcacaaaucacagcagguguugcguuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagaacucgcauuagacuuggcguugucuaaguaucugucugaucugcucuuuguuuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuuccuauacuaacagagauccaacaggcuuaugugcaggaguugcuuccagugaguuuuaauaacgauaauucagaauggaucagcauugucccgaauuucgugcugauuaggaacacgcugauuucaaauauagaaguuaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauucgcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcggcacugugcauuggucugaucacuuucauaagcuuuguaauaguugagaaaaagagagggaauuacagcaggcuagaugauaggcaggugcgaccggucaguaauggugaucuguauuauauuggaacauaa

SEQ ID NO: 842 - RNA, 1620 nt, Artificial Sequence
  derived and/or modified CDS sequence (wt) from Hendra henipavirus__AEQ38114__HsIgE(1-18)_F(26-546)
auggacuggaccuggauccuguuccucguggccgccgcgacccgcguccacagcgggauacuacauuaugagaaacuuaguaagauagggcugguuaaagguauuacaagaaaguacaagauuaagaguaacccuuugaccaaggauauuguaaucaaaaugaucccuaauguuucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcaggcguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagaacucgcauuagacuuggcguugucuaaguaucugucugaucugcucuuuguuuucggacccaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuuccuauacuaacagagauccaacaggcuuaugugcaggaguugcuuccagugaguuuuaauaacgauaauucagaauggaucagcauugucccgaauuucgugcugauuaggaacacgcugauuucaaauauagaaguuaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcggcacugugcauuggucugaucacuuucauaagcuuuauaauaguugagaaaaagagagggaauuacagcaggcuagaugauaggcaggugcgaccggucaguaauggugaucuguauuauauuggaacauaa

SEQ ID NO: 843 - RNA, 1617 nt, Artificial Sequence
  derived and/or modified CDS sequence (wt) from Hendra henipavirus__AAB39505__HsIgE(1-18)_F(27-546)
auggacuggaccuggauccuguuccucguggccgccgcgacccgcguccacagcauacuacauuaugagaaacuuaguaagauagggcugguuaaagguauuacaagaaaguacaagauuaagaguaacccuuugaccaaggauauugugaucaaaaugaucccuaaugucucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcagguguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagagcucgcauuagacuuggcguugucuaaguaucugcugaucugcucuuguuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuucccauacuaacagagauccaacaggcuuaugugcaggaguugcuuccagugaguuuuaauaacgauaauucagaauggaucagcauugucccgaauuucgugcugauuaggaacacgcugauuucaaauauagaagucaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaauccagggaacagacacuacugaugauugacaauacuaccugcacaacaguuguucuaggaaacauaaucauaagccuuccaaaauauuugggaucaauaaaguuacaaguucugagagcauugcuguugggccaccagucuauacagacaaagguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcagcacugugcauuggucugaucacuuucauaagcuuuguaauaguugagaaaaagagagggaauuacagcaggcuagaugauaggcaagugcgaccggucaguaauggugaucuguauuauauuggaacauaa

SEQ ID NO: 844 - RNA, 1653 nt, Artificial Sequence
  derived and/or modified CDS sequence (wt) from Nipah henipavirus__AAK50554__HsIgE(1-18)_G(70-602)
auggacuggaccuggauccuguuccucguggccgccgcgacccgcguccacagccaaaauuacacaagaucaacagacaaucaggccgugaucaaagaugcguugcaggguauccaacagcagaucaaagggcuugcugacaaaaucggcacagagauagggcccaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacucccuuuuagagaguauaggccacagacagaaggggugagcaaucuaguaggauuaccuaauaauauuugccugcaaaagacaucuaaucagauauugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucuggaccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaguuguauucauugaaauaucugaucaaagauuaucuauuggaucuccuagcaaaaucuaugauucuuugggucaaccuguuuucuaccaagcgucauuuucaugggauacuaugauuaaauuuggagauguucuaacagucaacccucugguugucaauuggcguaauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuuuacuguauucaaagauaaugaaauacuuuauagggcacaacuggcuucugaggacaccaaugcacaaaaaacaauaacuaauuguuuucucuugaagaauaagauuuggugcauaucauugguugagauauaugacacaggagacaaugucauaagacccaaacuauucgcgguuaagauaccagagcaauguacauaa

SEQ ID NO: 845 - RNA, 1653 nt, Artificial Sequence
  derived and/or modified CDS sequence (wt) from Nipah henipavirus__AEZ01389__HsIgE(1-18)_G(70-602)
auggacuggaccuggauccuguuccucguggccgccgcgacccgcguccacagccagaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuaucccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguguacaacaaugaauucuauuaugugcuuugugcagugucaguuguuggagacccuauucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguagguuuuuuggucaggacagaguucaaauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucaaccuguuuucuaccaagcgucuuuuucaugggacacuaugauuaaauuuggagauguccaaacaguuaacccuuuaguuguaaauuggcgugacaacacgguaaucucaagaccuggacaaucacaaugcccuagauucaacaagugcccagagguuugcugggaagggguuuauaaugaugccuuccugauugauagaaucaauuggauaagugcggguguauuccuugacagcaaccagaccgcagagaauccuguuuuuacuguauucaaagauaaugaaguacuuuacagagcacaacuagccuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 846 - RNA, 1653 nt, Artificial Sequence
  derived and/or modified CDS sequence (wt) from Nipah henipavirus__ACT32615__HsIgE(1-18)_G(70-602)
auggacuggaccuggauccuguuccucguggccgccgcgacccgcguccacagccaaaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuaucccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguauacaacaaugaauucuauuaugugcuuugugcagugucaguuguuggagacccuguucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguagguuuuuuggucaggacagaguucaaauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucagccuguuuucuaccaagcgucuuuuucaugggacacuaugauuaaauuuggagauguccaaacaguuaacccuuuaguuguaaauuggcgugacaacacgguaaucucaagaccugggcaaucacaaugcccuagauucaacaagugcccagagguuugcugggaagggguuuauaaugaugccuuccugauugauagaaucaauuggauaagugcggguguauuccuugacagcaaccagaccgcagagaauccuguuuuuacuguauucaaagauaaugaaguacuuuacagagcacaacuagcuuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 847 - RNA, 1653 nt, Artificial Sequence
  derived and/or modified CDS sequence (wt) from Nipah henipavirus__CAF25497__HsIgE(1-18)_G(70-602)
auggacuggaccuggauccuguuccucguggccgccgcgacccgcguccacagccaaaauuacacaagaucaacagacaaucaggccgugaucaaagaugcguugcaagguauccaacagcagaucaaagggcuugcugacaaaaucggcacagagauagggcccaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacucccuuuuagagaguauaggccacagacagaaggggugagcaaucugguaggauuaccuaauaauauuugccugcaaaagacaucuaaucagauauugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucugggccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaguuguauucauugaaauaucugaucaaagauuaucuauuggaucuccuagcaaaaucuaugauucuuugggucaaccuguuuucuaccaagcgucauuuucaugggauacuaugauuaaauuuggagauguucuaacagucaacccucugguugucaauuggcguaauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuuuacuguauucaaagauaaugaaauacuuuauagggcacaacuggcuucugaggacaccaaugcacaaaaaacaauaacuaauuguuuucucuugaagaauaagauuuggugcauaucauugguugagauauaugacacaggagacaaugucauaagacccaaacuauucgcgguuaagauaccagagcaauguacauaa

SEQ ID NO: 848 - RNA, 1653 nt, Artificial Sequence
  derived and/or modified CDS sequence (wt) from Nipah henipavirus__CBM41034__HsIgE(1-18)_G(70-602)
auggacuggaccuggauccuguuccucguggccgccgcgacccgcguccacagccaaaauuacacaagaucaacagacaaucaggccgugaucaaagaugcguugcaggguauccaacagcagaucaaagggcuugcugacaaaaucggcacagagauagggccuaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacuccccuuuagagaguauaggccgcagacagaaggggugagcaaucugguaggauuaccugauaauauuugccugcaaaagacaucuaaucagauacugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucuggaccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaauuguauucauugaaauaucugaucaaagauuaucuauuggaucuccuagcaaagucuaugauucuuugggucaaccuguuuucuaccaagcgucauuuucaugggauacuaugauuaaauuuggagauguucaaacagucaacccucugguugucaauuggcgugauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuucacuguauucaaagauaaugaaauacuuuauagggcacaacuggcuucugaggacaccaaugcacaaaaaacaauaacuaauugcuuucucuugaagaauaagauuuggugcauaucauugguugagauauaugacacaggagacaaugucauaagacccaaacuauucgcgguuaagauaccagagcaauguacauaa

SEQ ID NO: 849 - RNA, 1653 nt, Artificial Sequence
  derived and/or modified CDS sequence (wt) from Nipah henipavirus__AAX51853__HsIgE(1-18)_G(70-602)
auggacuggaccuggauccuguuccucguggccgccgcgacccgcguccacagccaaaauuauacaagaucaacagacaaucaggccgugaucaaagaugcguugcaggguauccaacagcagaucaaagggcuugcugacaaaaucggcacagagauagggcccaaaguaucacugauugacacauccaguacuauuacuaucccagcuaacauugggcuguuagguucaaagaucagccagucgacugcaaguauaaaugagaaugugaaugaaaaauguaaauucacauugccucccuugaaaauccacgaauguaacauuucuugucccaacccacucccuuuuagagaguauaggccgcagacagaaggagugagcaaucugguaggauuaccuaauaauauuugccugcaaaagacaucuaaucagauacugaagccaaagcugauuucauacacuuuaccuguagucggucaaagugguaccuguaucacagacccauugcuggcuauggacgagggcuauuuugcauauagccaccuggaaagaaucggaucauguucaagaggggucuccaaacaaaaaauaauaggaguuggagagguacuagacagaggugaugaaguuccuucuuuauuuaugaccaaugucuggaccccaccaaauccaaacacuguuuaccacuguagugcuguauacaacaaugaauucuauuaugugcuuugugcagugucaacuguuggagacccuauucugaauagcaccuacugguccggaucucuaaugaugacccgucuagcuguaaaacccaagaguaaugauggggguuacaaucaacaucaacuugcccuacgaaguaucgagaaagggagguaugauaaagucaugccguauggaccuucaggcaucaaacagggugacacccuguauuuuccugcuguaggauuuuuggucaggacagaguucaaauacaaugauucaaauugucccaucacgaagugucaauacaguaaaccugaaaauugcaggcuaucuauggggauuagaccaaacagccauuauguccuucgaucuggacuauuaaaauacaaucuaucagauggggagaacccuaaaauuguauucauugaaauaucugaucaaagauuaucuauuggaucuccuagcaaaaucuaugauucuuugggucaaccuguuuucuaccaagcgucauuuucaugggauacuaugauuaaauuuggagauguucaaacagucaacccuuugguuguaaguuggcgugauaacacgguaauaucaagaccugggcaaucgcaaugcccuagauucaauacauguccagagaucugcugggaaggaguuuauaaugaugcauuccuaauugacagaaucaauuggauaagcgcagguguauuccuugacagcaaucagaccgcagaaaauccuguuuuuacuguauucaaagauaaugaaauacuuuauagagcacaacuggcuucugaggacaccaaugcacaaaaaacaauaacuaauugcuuucucuugaagaauaagauuuggugcauaucauugguugagauauaugacacaggagacaaugucauaagacccaaacuauucgcaguuaagauaccagagcaauguacauaa

SEQ ID NO: 850 - RNA, 1653 nt, Artificial Sequence
  derived and/or modified CDS sequence (wt) from Nipah henipavirus__AEZ01397__HsIgE(1-18)_G(70-602)
auggacuggaccuggauccuguuccucguggccgccgcgacccgcguccacagccaaaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuauuccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguguacaacaaugaauucuauuaugugcuuugugcagugucaguuguuggagacccuauucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguaggauuuuuggucaggacagaguucacauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucaaccuguuuucuaccaagcaucuuuuucaugggacacuaugauuaaauuuggagauguccaaacaguuaacccuuuaguuguaaauuggcgugacaacacgguaaucucaagaccugggcaaucacaaugcccuagauucaacaagugcccagagguuugcugggaagggguuuauaaugaugcuuuccugauugauagaaucaauuggauaagcgcggguguauuccuugacagcaaccagaccgcagagaauccuguuuuuacuguauucaaagauaaugaaguacuuuacagagcacaacuagcuuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 851 - RNA, 1659 nt, Artificial Sequence
  derived and/or modified CDS sequence (wt) from Hendra henipavirus__NP_047112__HsIgE(1-18)_G(70-604)
auggacuggaccuggauccuguuccucguggccgccgcgacccgcguccacagccaaaauuacaccagaacgacugauaaucaggcacuaaucaaagagucacuccagaguguacagcaacaaaucaaagcuuuaacagacaaaaucgggacagagauaggccccaaagucucacuaauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaacuaaaguugaaagagggaaguacgauaaggugaugccuuacgguccaucagguaucaagcaaggggauacauuguacuuuccggccgucgguuuuuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucuaucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuauuugcagucaagauaccugcccaauguucagagaguuga

SEQ ID NO: 852 - RNA, 1659 nt, Artificial Sequence
  derived and/or modified CDS sequence (wt) from Hendra henipavirus__AEB21225__HsIgE(1-18)_G(70-604)
auggacuggaccuggauccuguuccucguggccgccgcgacccgcguccacagccaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacgucaacaaucuuaaagcccaggcugauauccuauacucuaccaauuaauaccagagaagggguuugcaucacugacccacuuuuggcuguugauaauggcuucuucgccuauagccaucuugaaaagaucggaucaugcacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaauggguguuaacuccaaaagucauuauauuuugagaucaggacuauugaaguauaaucugucucuuggaggagacaucacacuccaauuuaucgagauugcugacaauagauugaccaucgguucuccuaguaagauauacaauucucuaggucaaccugucuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 853 - RNA, 1659 nt, Artificial Sequence
  derived and/or modified CDS sequence (wt) from Hendra henipavirus__AEB21216__HsIgE(1-18)_G(70-604)
auggacuggaccuggauccuguuccucguggccgccgcgacccgcguccacagccaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaauccuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucacugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaaauaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucgaugggugucaacuccaaaagucauuauauuuugagaucaggacuauugaaguauaaucugucucuaggaggagacaucauacuucaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 854 - RNA, 1659 nt, Artificial Sequence
  derived and/or modified CDS sequence (wt) from Hendra henipavirus__AEB21206__HsIgE(1-18)_G(70-604)
auggacuggaccuggauccuguuccucguggccgccgcgacccgcguccacagccaaaauuacaccagaacgacugauaaucaggcacuaaucaaagagucgcuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggaaacuacaaucagaaauacaucgcuauaacuaaaguugaaagagggaaguacgauaaggugaugccuuacgguccaucagguaucaagcaaggggauacauuguacuuuccggccgucgguuuuuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucuaucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauauugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuauuugcagucaagauaccugcccaauguucagagaguuga

SEQ ID NO: 855 - RNA, 1659 nt, Artificial Sequence
  derived and/or modified CDS sequence (wt) from Hendra henipavirus__AEQ38052__HsIgE(1-18)_G(70-604)
auggacuggaccuggauccuguuccucguggccgccgcgacccgcguccacagccaaaacuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucacuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugcuguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 856 - RNA, 1659 nt, Artificial Sequence
  derived and/or modified CDS sequence (wt) from Hendra henipavirus__AEQ38115__HsIgE(1-18)_G(70-604)
auggacuggaccuggauccuguuccucguggccgccgcgacccgcguccacagccaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuaggggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcaguaucccaugugggagauccuauccuuaacaguacuuccuggacagagucacugucucugauucgucuugcuguaagaccaaaaagugauaauggagacuacaaucagaaauacaucgcuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucucuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 857 - RNA, 1659 nt, Artificial Sequence
  derived and/or modified CDS sequence (wt) from Hendra henipavirus__AEQ38108__HsIgE(1-18)_G(70-604)
auggacuggaccuggauccuguuccucguggccgccgcgacccgcguccacagccaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucacuauaacuaaaguugaaagagggaaguacgauaaggugaugccuuacgguccaucagguaucaagcaagggaauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugcuguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 858 - RNA, 1659 nt, Artificial Sequence
  derived and/or modified CDS sequence (wt) from Hendra henipavirus__AAV80426__HsIgE(1-18)_G(70-604)
auggacuggaccuggauccuguuccucguggccgccgcgacccgcguccacagccagaacuacacccggaccaccgauaaucaggcccugaucaaggagagccugcagucugugcagcagcagaucaaggcccugaccgacaagaucggcacagagaucggcccuaaagugagccugaucgacaccagcagcaccaucaccauccccgccaauaucggacugcugggcuccaagaucagccagugcaccagcuccaucaacgagaacgugaacgacaagugcaaguucacccugcccccccugaagauccacgagugcaacaucagcugccccaacccccugcccuucagagaguacaggcccaucagccagggagugagcgaucuggugggccugcccaaucagaucugccugcagaaaaccaccuccaccauccugaagccccggcugaucagcuacacccugcccaucaacacaagagagggcgugugcaucaccgauccucugcuggccguggacaacggcuucuucgccuacagccaccuggagaagaucggcagcugcacaagaggcaucgccaagcagagaaucaucggcgugggcgaagugcuggacagaggcgacaaagugcccagcauguucaugaccaacguguggacccccccuaauccuagcaccauccaccacugcagcagcaccuaccacgaggacuucuacuacacccugugcgccgugucucaugugggcgaccccauccugaauagcaccagcuggaccgagagccugucccugauuagacuggccgugaggcccaagagcgauagcggcgacuacaaccagaaguacaucgccaucaccaaaguggagcggggcaaguacgacaaagugaugcccuauggccccagcggaaucaagcagggcgacacccuguacuuucccgccgugggcuuucugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugacaaucggcagccccagcaagaucuacaacagccugggccagcccguguuuuaccaggccagcuacagcugggacaccaugaucaagcugggcgauguggacacaguggacccccugagagugcaguggcggaacaacagcgugaucagcagaccuggccagagccagugccccagauucaacgugugccccgaaguguguugggagggcagcuacaacgacgccuuccugaucgaccggcugaauugggugagcgccggaguguaccugaacagcaaccagaccgccgagaacccuguguucgccguguucaaggacaacgagauccuguaccaagugccccuggccgaggaugauaccaacgcccagaaaaccaucaccgacugcuuccugcuggagaacgugaucuggugcaucagccugguggagaucuacgacaccggcgacagcgugauuaggcccaagcuguucgcugugaagaucccugcccagugcagcgagagcuga

SEQ ID NO: 859 - RNA, 1617 nt, Artificial Sequence
  derived and/or modified CDS sequence (opt1) from Nipah henipavirus__AAK50553__HsIgE(1-18)_F(27-546)
auggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccuga

SEQ ID NO: 860 - RNA, 1617 nt, Artificial Sequence
  derived and/or modified CDS sequence (opt1) from Nipah henipavirus__AEZ01388__HsIgE(1-18)_F(27-546)
auggacuggaccuggauccuguuccucguggccgccgcgacccgcguccacagcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccuga

SEQ ID NO: 861 - RNA, 1617 nt, Artificial Sequence
  derived and/or modified CDS sequence (opt1) from Nipah henipavirus__AAY43915__HsIgE(1-18)_F(27-546)
auggacuggaccuggauccuguuccucguggccgccgcgacccgcguccacagcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccuga

SEQ ID NO: 862 - RNA, 1617 nt, Artificial Sequence
  derived and/or modified CDS sequence (opt1) from Nipah henipavirus__CAF25496__HsIgE(1-18)_F(27-546)
auggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacguga

SEQ ID NO: 863 - RNA, 1617 nt, Artificial Sequence
  derived and/or modified CDS sequence (opt1) from Nipah henipavirus__AAM13405__HsIgE(1-18)_F(27-546)
auggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccuga

SEQ ID NO: 864 - RNA, 1617 nt, Artificial Sequence
  derived and/or modified CDS sequence (opt1) from Nipah henipavirus__CBM41033__HsIgE(1-18)_F(27-546)
auggacuggaccuggauccuguuccucguggccgccgcgacccgcguccacagcauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccuga

SEQ ID NO: 865 - RNA, 1617 nt, Artificial Sequence; identical to SEQ ID NO: 860
  derived and/or modified CDS sequence (opt1) from Nipah henipavirus__AEZ01396__HsIgE(1-18)_F(27-546)

SEQ ID NO: 866 - RNA, 1617 nt, Artificial Sequence
  derived and/or modified CDS sequence (opt1) from Hendra henipavirus__NP_047111__HsIgE(1-18)_F(27-546)
auggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacguga

SEQ ID NO: 867 - RNA, 1617 nt, Artificial Sequence
  derived and/or modified CDS sequence (opt1) from Hendra henipavirus__AEB21233__HsIgE(1-18)_F(27-546)
auggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccuga

SEQ ID NO: 868 - RNA, 1620 nt, Artificial Sequence
  derived and/or modified CDS sequence (opt1) from Hendra henipavirus__AEQ38114__HsIgE(1-18)_F(26-546)
auggacuggaccuggauccuguuccucguggccgccgcgacccgcguccacagcggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccuga

SEQ ID NO: 869 - RNA, 1617 nt, Artificial Sequence
  derived and/or modified CDS sequence (opt1) from Hendra henipavirus__AAB39505__HsIgE(1-18)_F(27-546)
auggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccuga

SEQ ID NO: 870 - RNA, 1653 nt, Artificial Sequence
  derived and/or modified CDS sequence (opt1) from Nipah henipavirus__AAK50554__HsIgE(1-18)_G(70-602)
auggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccuga

SEQ ID NO: 871 - RNA, 1653 nt, Artificial Sequence
  derived and/or modified CDS sequence (opt1) from Nipah henipavirus__AEZ01389__HsIgE(1-18)_G(70-602)
auggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccuga

SEQ ID NO: 872 - RNA, 1653 nt, Artificial Sequence
  derived and/or modified CDS sequence (opt1) from Nipah henipavirus__ACT32615__HsIgE(1-18)_G(70-602)
auggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccuga

SEQ ID NO: 873 - RNA, 1653 nt, Artificial Sequence
  derived and/or modified CDS sequence (opt1) from Nipah henipavirus__CAF25497__HsIgE(1-18)_G(70-602)
auggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccuga

SEQ ID NO: 874 - RNA, 1653 nt, Artificial Sequence
  derived and/or modified CDS sequence (opt1) from Nipah henipavirus__CBM41034__HsIgE(1-18)_G(70-602)
auggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccuga

SEQ ID NO: 875 - RNA, 1653 nt, Artificial Sequence
  derived and/or modified CDS sequence (opt1) from Nipah henipavirus__AAX51853__HsIgE(1-18)_G(70-602)
auggacuggaccuggauccuguuccucguggccgccgcgacccgcguccacagccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccuga

SEQ ID NO: 876 - RNA, 1653 nt, Artificial Sequence
  derived and/or modified CDS sequence (opt1) from Nipah henipavirus__AEZ01397__HsIgE(1-18)_G(70-602)
auggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacguga

SEQ ID NO: 877 - RNA, 1659 nt, Artificial Sequence
  derived and/or modified CDS sequence (opt1) from Hendra henipavirus__NP_047112__HsIgE(1-18)_G(70-604)
auggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcuga

SEQ ID NO: 878 - RNA, 1659 nt, Artificial Sequence
  derived and/or modified CDS sequence (opt1) from Hendra henipavirus__AEB21225__HsIgE(1-18)_G(70-604)
auggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcuga

SEQ ID NO: 879 - RNA, 1659 nt, Artificial Sequence
  derived and/or modified CDS sequence (opt1) from Hendra henipavirus__AEB21216__HsIgE(1-18)_G(70-604)
auggacuggaccuggauccuguuccucguggccgccgcgacccgcguccacagccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcuga

SEQ ID NO: 880 - RNA, 1659 nt, Artificial Sequence
  derived and/or modified CDS sequence (opt1) from Hendra henipavirus__AEB21206__HsIgE(1-18)_G(70-604)
auggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcuga

SEQ ID NO: 881 - RNA, 1659 nt, Artificial Sequence
  derived and/or modified CDS sequence (opt1) from Hendra henipavirus__AEQ38052__HsIgE(1-18)_G(70-604)
auggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcuga

SEQ ID NO: 882 - RNA, 1659 nt, Artificial Sequence
  derived and/or modified CDS sequence (opt1) from Hendra henipavirus__AEQ38115__HsIgE(1-18)_G(70-604)
auggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccuga

SEQ ID NO: 883 - RNA, 1659 nt, Artificial Sequence
  derived and/or modified CDS sequence (opt1) from Hendra henipavirus__AEQ38108__HsIgE(1-18)_G(70-604)
auggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcuga

SEQ ID NO: 884 - RNA, 1659 nt, Artificial Sequence
  derived and/or modified CDS sequence (opt1) from Hendra henipavirus__AAV80426__HsIgE(1-18)_G(70-604)
auggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcuga

SEQ ID NO: 885 - RNA, 1617 nt, Artificial Sequence
  derived and/or modified CDS sequence (opt2) from Nipah henipavirus__AAK50553__HsIgE(1-18)_F(27-546)
auggacuggaccuggauccucuuccucgucgccgccgccacccgcguccacuccauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 886 - RNA, 1617 nt, Artificial Sequence
  derived and/or modified CDS sequence (opt2) from Nipah henipavirus__AEZ01388__HsIgE(1-18)_F(27-546)
auggacuggaccuggauccucuuccucgucgccgccgccacccgcguccacuccauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 887 - RNA, 1617 nt, Artificial Sequence
  derived and/or modified CDS sequence (opt2) from Nipah henipavirus__AAY43915__HsIgE(1-18)_F(27-546)
auggacuggaccuggauccucuuccucgucgccgccgccacccgcguccacuccauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguacuccuccgaccuccucuucgucuucggccccaaccuccaggaccccgucuccaacuccaugaccauccaggccaucucccaggccuucggcggcaacuacgagacccuccuccgcacccucggcuacgccaccgagggcuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 888 - RNA, 1617 nt, Artificial Sequence
  derived and/or modified CDS sequence (opt2) from Nipah henipavirus__CAF25496__HsIgE(1-18)_F(27-546)
auggacuggaccuggauccucuuccucgucgccgccgccacccgcguccacuccauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaucgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 889 - RNA, 1617 nt, Artificial Sequence
  derived and/or modified CDS sequence (opt2) from Nipah henipavirus__AAM13405__HsIgE(1-18)_F(27-546)
auggacuggaccuggauccucuuccucgucgccgccgccacccgcguccacuccauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaccaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 890 - RNA, 1617 nt, Artificial Sequence
  derived and/or modified CDS sequence (opt2) from Nipah henipavirus__CBM41033__HsIgE(1-18)_F(27-546)
auggacuggaccuggauccucuuccucgucgccgccgccacccgcguccacuccauccuccacuacgagaagcucuccaagaucggccucgucaagggcgucacccgcaaguacaagaucaaguccaacccccucaccaaggacaucgucaucaagaugaucgccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaaguccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 891 - RNA, 1617 nt, Artificial Sequence; identical to SEQ ID NO: 886
  derived and/or modified CDS sequence (opt2) from Nipah henipavirus__AEZ01396__HsIgE(1-18)_F(27-546)

SEQ ID NO: 892 - RNA, 1617 nt, Artificial Sequence
  derived and/or modified CDS sequence (opt2) from Hendra henipavirus__NP_047111__HsIgE(1-18)_F(27-546)
auggacuggaccuggauccucuuccucgucgccgccgccacccgcguccacuccauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucgccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 893 - RNA, 1617 nt, Artificial Sequence
  derived and/or modified CDS sequence (opt2) from Hendra henipavirus__AEB21233__HsIgE(1-18)_F(27-546)
auggacuggaccuggauccucuuccucgucgccgccgccacccgcguccacuccauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 894 - RNA, 1620 nt, Artificial Sequence
  derived and/or modified CDS sequence (opt2) from Hendra henipavirus__AEQ38114__HsIgE(1-18)_F(26-546)
auggacuggaccuggauccucuuccucgucgccgccgccacccgcguccacuccggcauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucaucaucgucgagaagaagcgcggcaacuacucccgccucgacgaccgccagguccgccccgucuccaacggcgaccucuacuacaucggcaccuga

SEQ ID NO: 895 - RNA, 1617 nt, Artificial Sequence
  derived and/or modified CDS sequence (opt2) from Hendra henipavirus__AAB39505__HsIgE(1-18)_F(27-546)
auggacuggaccuggauccucuuccucgucgccgccgccacccgcguccacuccauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccuccucaucugcuccugcuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccagucccgcgagcagacccuccucaugaucgacaacaccaccugcaccaccgucguccucggcaacaucaucaucucccuccccaaguaccucggcuccaucaagcuccagguccuccgcgcccuccuccucggccaccaguccauccagaccaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 896 - RNA, 1653 nt, Artificial Sequence
  derived and/or modified CDS sequence (opt2) from Nipah henipavirus__AAK50554__HsIgE(1-18)_G(70-602)
auggacuggaccuggauccucuuccucgucgccgccgccacccgcguccacucccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaaggucgucuucaucgagaucuccgaccagcgccucuccaucggcucccccuccaagaucuacgacucccucggccagcccgucuucuaccaggccuccuucuccugggacaccaugaucaaguucggcgacguccucaccgucaacccccucgucgucaacuggcgcaacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 897 - RNA, 1653 nt, Artificial Sequence
  derived and/or modified CDS sequence (opt2) from Nipah henipavirus__AEZ01389__HsIgE(1-18)_G(70-602)
auggacuggaccuggauccucuuccucgucgccgccgccacccgcguccacucccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccauccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaaguacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 898 - RNA, 1653 nt, Artificial Sequence
  derived and/or modified CDS sequence (opt2) from Nipah henipavirus__ACT32615__HsIgE(1-18)_G(70-602)
auggacuggaccuggauccucuuccucgucgccgccgccacccgcguccacucccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccguccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaaguacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 899 - RNA, 1653 nt, Artificial Sequence
  derived and/or modified CDS sequence (opt2) from Nipah henipavirus__CAF25497__HsIgE(1-18)_G(70-602)
auggacuggaccuggauccucuuccucgucgccgccgccacccgcguccacucccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucugggccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaaggucgucuucaucgagaucuccgaccagcgccucuccaucggcucccccuccaagaucuacgacucccucggccagcccgucuucuaccaggccuccuucuccugggacaccaugaucaaguucggcgacguccucaccgucaacccccucgucgucaacuggcgcaacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 900 - RNA, 1653 nt, Artificial Sequence
  derived and/or modified CDS sequence (opt2) from Nipah henipavirus__CBM41034__HsIgE(1-18)_G(70-602)
auggacuggaccuggauccucuuccucgucgccgccgccacccgcguccacucccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccgacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaagaucgucuucaucgagaucuccgaccagcgccucuccaucggcucccccuccaaggucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 901 - RNA, 1653 nt, Artificial Sequence
  derived and/or modified CDS sequence (opt2) from Nipah henipavirus__AAX51853__HsIgE(1-18)_G(70-602)
auggacuggaccuggauccucuuccucgucgccgccgccacccgcguccacucccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagaagaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacgacggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacguccuccgcuccggccuccucaaguacaaccucuccgacggcgagaaccccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucuccuggcgcgacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 902 - RNA, 1653 nt, Artificial Sequence
  derived and/or modified CDS sequence (opt2) from Nipah henipavirus__AEZ01397__HsIgE(1-18)_G(70-602)
auggacuggaccuggauccucuuccucgucgccgccgccacccgcguccacucccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccauccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaccuacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 903 - RNA, 1659 nt, Artificial Sequence
  derived and/or modified CDS sequence (opt2) from Hendra henipavirus__NP_047112__HsIgE(1-18)_G(70-604)
auggacuggaccuggauccucuuccucgucgccgccgccacccgcguccacucccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 904 - RNA, 1659 nt, Artificial Sequence
  derived and/or modified CDS sequence (opt2) from Hendra henipavirus__AEB21225__HsIgE(1-18)_G(70-604)
auggacuggaccuggauccucuuccucgucgccgccgccacccgcguccacucccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucacccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 905 - RNA, 1659 nt, Artificial Sequence
  derived and/or modified CDS sequence (opt2) from Hendra henipavirus__AEB21216__HsIgE(1-18)_G(70-604)
auggacuggaccuggauccucuuccucgucgccgccgccacccgcguccacucccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaacaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 906 - RNA, 1659 nt, Artificial Sequence
  derived and/or modified CDS sequence (opt2) from Hendra henipavirus__AEB21206__HsIgE(1-18)_G(70-604)
auggacuggaccuggauccucuuccucgucgccgccgccacccgcguccacucccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcaacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacaucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 907 - RNA, 1659 nt, Artificial Sequence
  derived and/or modified CDS sequence (opt2) from Hendra henipavirus__AEQ38052__HsIgE(1-18)_G(70-604)
auggacuggaccuggauccucuuccucgucgccgccgccacccgcguccacucccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucaccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 908 - RNA, 1659 nt, Artificial Sequence
  derived and/or modified CDS sequence (opt2) from Hendra henipavirus__AEQ38115__HsIgE(1-18)_G(70-604)
auggacuggaccuggauccucuuccucgucgccgccgccacccgcguccacucccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacaacggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 909 - RNA, 1659 nt, Artificial Sequence
  derived and/or modified CDS sequence (opt2) from Hendra henipavirus__AEQ38108__HsIgE(1-18)_G(70-604)
auggacuggaccuggauccucuuccucgucgccgccgccacccgcguccacucccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucaccaucaccaaggucgagcgcggcaaguacgacaaggucaugcccuacggccccuccggcaucaagcagggcaacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 910 - RNA, 1659 nt, Artificial Sequence
  derived and/or modified CDS sequence (opt2) from Hendra henipavirus__AAV80426__HsIgE(1-18)_G(70-604)
auggacuggaccuggauccucuuccucgucgccgccgccacccgcguccacucccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccagugcaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcuccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 911 - RNA, 1617 nt, Artificial Sequence
  derived and/or modified CDS sequence (opt3) from Nipah henipavirus__AAK50553__HsIgE(1-18)_F(27-546)
auggacuggaccuggauccuguuccucguggccgcugcaacaagaguccacagcauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaccgaggacuuugaugaccugcucgagagugauagcaucacaggucagauaauuuacguggaccuuucuuccuauuacaucaucguacguguguauuucccaauucugaccgaaauccaacaggccuacauucaggaguugcuacccgucucauuuaacaaugacaacagcgaauggauaaguaucgugccuaauuucauucugguuagaaacacgcucaucucuaauaucgagauuggcuuuugucugauaacuaagagguccgugaucugcaaccaggauuaugcaacaccaaugaccaauaacaugcgggaaugucuuacugggagcacagagaaaugcccccgcgagcuggucgugucgucucacguaccuagauucgcuuuguccaauggaguucucuuugccaacuguauuucagugaccugccaaugucagacgaccggcagggcgaucagucagagcggugaacaaacacuguuaaugauugacaauacuaccugcccaacagccguccuggggaacgugaucauaucccuaggaaaguaccucggcucugucaauuacaacagcgagggcaucgcaauugggccgcccguguucacugauaagguugacaucucaagucagauuuccagcaugaaucagucucugcagcaaucaaaagauuauaucaaggaagcucagcggcuuuuggacaccgugaacccuagucugauaagcaugcucuccaugauuauccuguacguacuuucuauugccucgcugugcaucggauugauaacauuuaucagcuucauuaucgucgagaaaaagcgcaacaccuauucccgacucgaagauagaagggugcggccaacuucaaguggugaccuguacuauauuggcacguga

SEQ ID NO: 912 - RNA, 1617 nt, Artificial Sequence
  derived and/or modified CDS sequence (opt3) from Nipah henipavirus__AEZ01388__HsIgE(1-18)_F(27-546)
auggacuggaccuggauccuguuccucguggccgcugcaacaagaguccacagcaucuuacacuacgaaaaacugucaaagauugggcuaguuaaaggaaucaccaggaaguauaaaauaaagaguaacccccucacaaaggacaucgugauuaaaaugaucccuaauguaagcaacaugucccaguguacugguucugugauggagaauuacaagacgcggcugaacggcauucuuaccccaaucaaaggggcucuggaaauauauaagaauaacacacaugauuuggucggagacgugcgccucgcaggcguuauuauggccgguguggcgaucgggauugcuacugccgcacaaaucaccgccggagucgcucuguacgaggcaaugaaaaaugccgauaacaucaauaagcugaagucgucaauugaaagcacaaacgaggcugugguaaaacuccaggagaccgccgaaaagacuguuuauguguuaacagcgcugcaggacuacauaaauaccaaccuugucccgacgaucgauaaaauuaguugcaagcagacugaguugucccuggaccuagcacucucuaaauaccugagcgaucuucuguucguguuuggccccaauuugcaagacccuguguccaacucaaugaccauccaggccauaagucaggcuuucggcgggaacuaugaaacacuccugcgaacuuuaggauacgccaccgaggauuuugacgaucugcucgagagcgacucuauuacaggucagaucaucuaugucgaucuuuccggcuacuauauuaucguucguguguacuucccaauucugaccgaaauacaacaggcauauauccaggaguugcuacccguaucauuuaauaacgacaauagcgaauggauuaguaucgugccuaacuucauccuggucagaaauacgcucauuucuaacauagagaucggguuuugucugauuacuaagagguccgugaucugcaaucaggacuacgcuacaccaaugaccaacaauaugcgggaaugucuuacuggaagcacagagaaaugcccccgcgagcugguugugucgucucacgucccuagauucgccuuguccaacggcgugcucuuugcgaauuguauuucaguaaccugccaaugucagacgaccgguagggccaucagucagagcggggaacaaacacuguuaaugauagauaacacuaccugcccaacagcaguucugggaaaugugaucauuucccuaggcaaguaccucggcucugucaacuauaauagcgaggggaucgcuauuggaccgcccguguucacugacaaggucgauaucucaagucagauauccagcaugaaccagucucugcagcaaucaaaagacuacauuaaggaagcccagcggcuuuuggauaccgugaacccuagucugaucagcaugcucuccaugauuauccuguauguucuuucuauagcuucgcuguguaucgguuugauuacauuuaucagcuucauuaucguggagaaaaagcgcaauaccuacucccgacucgaagacagaaggguacggccaacuucaaguggcgaucuguauuacauagggacguga

SEQ ID NO: 913 - RNA, 1617 nt, Artificial Sequence
  derived and/or modified CDS sequence (opt3) from Nipah henipavirus__AAY43915__HsIgE(1-18)_F(27-546)
auggacuggaccuggauccuguuccucguggccgcugcaacaagaguccacagcauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauacagcuccgaucugcuuuucguguuuggccccaaucugcaagacccugugucaaacaguaugaccauucaggccaucagccaggcuuucggcgggaacuaugaaacauugcuccgaacucugggauacgccaccgaggguuuugaugacuuacuggagucugauuccauaacaggccagauuaucuaugucgaccucucaggguacuauaucauuguucguguguacuucccaauccuuaccgaaauucaacaggcauauauacaggagcuguugcccguaaguuuuaauaacgauaauagugaauggaucucuauugugccuaacuucauccuagucagaaauacgcugaucuccaacauugagauaggauuuugucucaucacuaagaggagcgugauuugcaaucaggacuacgcuacaccaaugaccaacaauaugcgggaaugucugacuggcucgacagagaaaugcccccgcgagcuuguugugucuucccacgucccuagauucgcccugucaaacgguguguuguuugcgaauuguaucaguguaaccugccaaugucagacgaccgggagggccauuagccaguccggagaacaaacacuccugaugaucgacaacacuaccugcccaacagcaguuuuaggcaaugugauaaucucucugggcaaguaccuagggagcgucaacuauaauucagagggaauugcuaucgguccgcccguguucacugauaaggucgacauuaguucccagaucagcucuaugaaccagucacuccagcaaaguaaagauuacauaaaggaagcccagcggcugcuugacaccgugaacccuagcuugauuuccaugcugucuaugaucauucucuauguucugucgaucgcuagccuuuguauaggccugaucacauuuauuuccuucaucauuguggagaaaaagcgcaauaccuacucacgauuggaagauagaaggguacggccaacuagcucuggggaccucuauuacaucggaacguga

SEQ ID NO: 914 - RNA, 1617 nt, Artificial Sequence
  derived and/or modified CDS sequence (opt3) from Nipah henipavirus__CAF25496__HsIgE(1-18)_F(27-546)
auggacuggaccuggauccuguuccucguggccgcugcaacaagaguccacagcauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaucgaggacuuugaugaccugcucgagagugauagcauaaccggucagauuaucuacguggaccuuucuuccuauuacaucauuguacguguguauuucccaauccugacagaaauucaacaggccuacauacaggaguugcuacccgucucauuuaacaaugacaacagcgaauggaucaguauugugccuaauuucauccugguuagaaacacccucaucucuaauauugagauaggcuuuugucugaucacgaagagguccgugauuugcaaccaggauuaugcaacuccaaugacaaauaacaugcgggaaugucuuaccgggagcacugagaaaugcccccgcgagcuggucgugucgucucacguaccuagauucgcuuuguccaauggaguucucuuugccaacuguaucucagugacaugccaaugucagaccacgggcagggcgauuagucagagcggugaacaaacccuguuaaugaucgacaauacaacuugcccaaccgccguccuggggaacgugauaaucucccuaggaaaguaccucggcucugucaauuacaacagcgagggcauugcaaucgggccgcccguguucacagauaagguugacauuucaagucagaucuccagcaugaaucagucucugcagcaaucaaaagauuauauaaaggaagcucagcggcuuuuggacacugugaacccuagucugauuagcaugcucuccaugaucauucuguacguacuuucuaucgccucgcugugcauaggauugaucaccuuuauuagcuucaucauugucgagaaaaagcgcaacacauauucccgacucgaagauagaagggugcggccaaccucaaguggugaccuguacuauaucggcacuuga

SEQ ID NO: 915 - RNA, 1617 nt, Artificial Sequence
  derived and/or modified CDS sequence (opt3) from Nipah henipavirus__AAM13405__HsIgE(1-18)_F(27-546)
auggacuggaccuggauccuguuccucguggccgcugcaacaagaguccacagcauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaccgaggacuuugaugaccugcucgagagugauagcaucacaggucagauaauuuacguggaccuuucuuccuauuacaucaucguacguguguauuucccaauucugaccgaaauccaacaggccuacauucaggaguugcuacccgucucauuuaacaaugacaacagcgaauggauaaguaucgugccuaauuucauucugguuagaaacacgcucaucucuaauaucgagauuggcuuuugucugauaacuaagagguccgugaucugcaaccaggauuaugcaacaccaaccacuaauaacaugcgggaaugucuuacagggagcaccgagaaaugcccccgcgagcuggucgugucgucucacguaccuagauucgcuuuguccaauggaguucucuuugccaacuguauuucagugacgugccaaugucagaccacaggcagggcgaucagucagagcggugaacaaacucuguuaaugauugacaauaccacaugcccaacugccguccuggggaacgugaucauaucccuaggaaaguaccucggcucugucaauuacaacagcgagggcaucgcaauugggccgcccguguucaccgauaagguugacaucucaagucagauuuccagcaugaaucagucucugcagcaaucaaaagauuauaucaaggaagcucagcggcuuuuggacacagugaacccuagucugauaagcaugcucuccaugauuauccuguacguacuuucuauugccucgcugugcaucggauugauaaccuuuaucagcuucauuaucgucgagaaaaagcgcaacacuuauucccgacucgaagauagaagggugcggccaacgucaaguggugaccuguacuauauuggcacauga

SEQ ID NO: 916 - RNA, 1617 nt, Artificial Sequence
  derived and/or modified CDS sequence (opt3) from Nipah henipavirus__CBM41033__HsIgE(1-18)_F(27-546)
auggacuggaccuggauccuguuccucguggccgcugcaacaagaguccacagcauuuuacacuaugaaaaacugucaaagaucgggcuagugaaaggaguaaccaggaaguacaaaauuaagaguaauccccucacaaaggauaucgugauaaaaaugaucgccaacgucagcaauaugucccagugcacugguucugugauggagaacuauaagacgcggcugaauggcauucuuaccccuaucaaaggggcucuggaaauuuacaagaacaauacacaugacuugguuggagaugugcgccucgcaggcgucaucauggccgguguggcgauagggauugcuacugccgcacaaaucaccgccggaguagcucuguaugaggcaaugaaaaacgccgacaauauuaacaagcugaagucgucaaucgaaagcacaaaugaggcuguugugaaacuccaggagaccgccgaaaagacugucuacguguuaacagcgcugcaggauuauaucaacaccaaucuugugccaacgauugacaaaauaaguuguaagcagacugaguugucccuggaucuagcacucucuaaauaccugagcgaccuucuguucgucuuuggcccgaacuugcaagaucccguuuccaauucaaugaccauccaggccauuagucaggcuuucggcgggaacuacgaaacacuccugcgaacuuuaggauaugccaccgaggacuuugaugaccugcucgagagcgauucuaucacaggucagauaauuuacguggaccuuuccucauauuacaucaucguacguguguauuucccuauucugaccgaaauccaacaggcauacauucaggaguugcuaccagucagcuuuaacaaugacaacagugaauggauaucuaucgugcccaauuucauucugguuagaaacacgcucaucuccaauaucgagauuggcuuuugccugauaacuaagaggagcgugaucuguaaccaggauuaugcuacaccuaugaccaauaacaugcgggaaugccuuacugggucgacagagaaauguccacgcgagcuggucgugucuucccacguacccagauucgccuugucaaauggaguucucuuugcgaacugcauuagugugaccugucaaugccagacgaccggcagggccaucagccaguccggugaacaaacacuguuaaugauugacaauacuaccuguccuacagcaguccuggggaacgugaucauaucucuaggaaaguaccucggcagcgucaauuacaacucagagggcaucgcuauugggccaccgguguucacugauaagguugacaucaguucccagaaaagcucuaugaaucagucacugcagcaaaguaaggauuauauuaaagaagcccagcggcuuuuggacaccgugaaccccagccugaucuccaugcucucuaugauaauucuguacguacuuucgaucgcuagccugugcauuggauugaucacauuuauauccuucaucauugucgagaagaaacgcaacaccuauucacgacucgaagauagaagggugcggccuacgaguucuggugaccuguacuauaucggcacuuga

SEQ ID NO: 917 - RNA, 1617 nt, Artificial Sequence
  derived and/or modified CDS sequence (opt3) from Nipah henipavirus__AEZ01396__HsIgE(1-18)_F(27-546)
auggacuggaccuggauccuguuccucguggccgcugcaacaagaguccacagcauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauaccugagcgaucuucuguucguguuuggccccaauuugcaagacccuguguccaacucaaugaccauucaggccaucagucaggcuuucggcgggaacuaugaaacacuccugcgaacuuuaggauacgccaccgaggauuuugacgaucugcucgagagcgacucuauaacaggucagauuaucuaugucgaucuuuccggcuacuauaucauuguucguguguacuucccaauccugaccgaaauucaacaggcauauauacaggaguugcuacccguaucauuuaauaacgacaauagcgaauggaucaguauugugccuaacuucauccuggucagaaauacgcucaucucuaacauugagauaggguuuugucugaucacuaagagguccgugauuugcaaucaggacuacgcuacaccaaugaccaacaauaugcgggaaugucuuacuggaagcacagagaaaugcccccgcgagcugguugugucgucucacgucccuagauucgccuuguccaacggcgugcucuuugcgaauuguaucucaguaaccugccaaugucagacgaccgguagggccauuagucagagcggggaacaaacacuguuaaugaucgauaacacuaccugcccaacagcaguucugggaaaugugauaaucucccuaggcaaguaccucggcucugucaacuauaauagcgaggggauugcuaucggaccgcccguguucacugacaaggucgauauuucaagucagaucuccagcaugaaccagucucugcagcaaucaaaagacuacauaaaggaagcccagcggcuuuuggauaccgugaacccuagucugauuagcaugcucuccaugaucauucuguauguucuuucuaucgcuucgcuguguauagguuugaucacauuuauuagcuucaucauuguggagaaaaagcgcaauaccuacucccgacucgaagacagaaggguacggccaacuucaaguggcgaucuguauuacaucgggacguga

SEQ ID NO: 918 - RNA, 1617 nt, Artificial Sequence
  derived and/or modified CDS sequence (opt3) from Hendra henipavirus__NP_047111__HsIgE(1-18)_F(27-546)
auggacuggaccuggauccuguuccucguggccgcugcaacaagaguccacagcauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauugcugggcaaaucguguauguagauuugagcucuuacuauauaauugugcgagucuacuucccaauccuaaccgagauccagcaggccuaugugcaggaacugcuccccguuuccuuuaacaacgacaauucagaguggauuagcaucgugccuaacuucguccugauucguaauacgcuuauaaguaacaucgaagugaaguacugccugauuacuaaaaagucuguaaucuguaaucaagacuaugcgacaccaaugaccgccuccguuagagagugcuugacuggaagcacagauaagugucccagggagcucguggucucgucucacgugccucgguuugcacuguccggcggugucuuauucgcuaacugcaucucagugaccugucagugccagacgaccgggcgcgccauuagucaaagcggagaacagacacugcuaaugauagacaauacuaccuguacaacuguugugcucggcaacaucauuaucucccugggcaaauaccuugggucuauuaauuacaacagcgagucaaucgcuguaggaccaccggucuauaccgauaagguggacauaaguucccagaucagcucuaugaaucagucauugcaacagaguaaagauuacauuaaggaagcccagaaaauccuggacacaguuaaccccagccucauuuccaugcugucuaugaucauacuuuaugugcugucgauugcagccuugugcaucggucucauuaccuuuaucagcuucgucauaguggagaagaagagaggcaauuacuccaggcuggaugaccggcagguacgcccugugucaaacggggauuuauauuacaucggaacuuga

SEQ ID NO: 919 - RNA, 1617 nt, Artificial Sequence
  derived and/or modified CDS sequence (opt3) from Hendra henipavirus__AEB21233__HsIgE(1-18)_F(27-546)
auggacuggaccuggauccuguuccucguggccgcugcaacaagaguccacagcauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauuaccgggcaaaucguguauguagauuugagcucuuacuauauaauugugcgagucuacuucccaauccuaacggagauccagcaggcuuaugugcaggaacugcuccccguuuccuuuaacaacgacaauucagaguggauuagcaucgugccuaacuucguccugauucguaauacucuuauaaguaacaucgaagugaaguacugccugauuaccaaaaagucuguaaucuguaaucaagacuaugccacaccaaugacugcguccguuagagagugcuugacaggaagcaccgauaagugucccagggagcucguggucucgucucacgugccucgguuugcccuguccggcggugucuuauucgcaaacugcaucucagugacgugucagugccagaccacagggcgcgcuauuagucaaagcggagaacagacucugcuaaugauagacaauaccacauguacuaccguugugcucggcaacaucauuaucucccugggcaaauaccuugggucuauuaauuacaacagcgagucaaucgccguaggaccaccggucuauacagauaagguggacauaaguucccagaucagcucuaugaaucagucauugcaacagaguaaagauuacauuaaggaagcucagaaaauccuggacaccguuaaccccagccucauuuccaugcugucuaugaucauacuuuaugugcugucgauugccgcauugugcaucggucucauuacuuuuaucagcuucgucauaguggagaagaagagaggcaauuacuccaggcuggaugaccggcagguacgcccugugucaaacggggauuuauauuacaucggaacguga

SEQ ID NO: 920 - RNA, 1620 nt, Artificial Sequence
  derived and/or modified CDS sequence (opt3) from Hendra henipavirus__AEQ38114__HsIgE(1-18)_F(26-546)
auggacuggaccuggauccuguuccucguggccgcugcaacaagaguccacagcggaauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauuaccgggcaaaucguguauguagauuugagcucuuacuauauaauugugcgagucuacuucccaauccuaacggagauccagcaggcuuaugugcaggaacugcuccccguuuccuuuaacaacgacaauucagaguggauuagcaucgugccuaacuucguccugauucguaauacucuuauaaguaacaucgaagugaaguacugccugauuaccaaaaagucuguaaucuguaaucaagacuaugccacaccaaugacugcguccguuagagagugcuugacaggaagcaccgauaagugucccagggagcucguggucucgucucacgugccucgguuugcccuguccggcggugucuuauucgcaaacugcaucucagugacgugucagugccagaccacagggcgcgcuauuagucaaagcggagaacagacucugcuaaugauagacaauaccacauguacuaccguugugcucggcaacaucauuaucucccugggcaaauaccuugggucuauuaauuacaacagcgagucaaucgccguaggaccaccggucuauacagauaagguggacauaaguucccagaucagcucuaugaaucagucauugcaacagaguaaagauuacauuaaggaagcucagaaaauccuggacaccguuaaccccagccucauuuccaugcugucuaugaucauacuuuaugugcugucgauugccgcauugugcaucggucucauuacuuuuaucagcuucauaaucgucgagaagaagagaggcaauuacuccaggcuggaugaccgccaggugcggccuguaucaaacggggauuuauauuacauuggaacguga

SEQ ID NO: 921 - RNA, 1617 nt, Artificial Sequence
  derived and/or modified CDS sequence (opt3) from Hendra henipavirus__AAB39505__HsIgE(1-18)_F(27-546)
auggacuggaccuggauccuguuccucguggccgcugcaacaagaguccacagcauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguugauaugcuccuguuucgggcccaaucuccaggauccugucucuaacagcaugacaauccaggcuauuucccaggccuuuggagguaauuacgagacucuguuacgcacccugggcuacgcaacagaggacuucgaugaccuccuugaaucagauaguaucaccgggcaaauaguuuauguggaccugagcucuuacuauauuaucguacgaguguacuuuccaaucuugacggagauucagcaggcuuauguccaggaacuacugcccguguccuucaacaacgauaauucagaguggaucagcauuguuccuaacuuugugcucauacguaauacucugaucaguaacauugaagucaaguacugccuuaucacaaagaagucugugaucuguaaucaagacuaugccaccccaaugacugcguccguaagagagugccugacaggaagcaccgacaagugucccagggaguugguugugucgucucacgucccucgguucgcccucuccggcggugugcuguuugcaaacugcauuucagucacgugucagugccagaccacagggcgcgcuauaagucaaagcagagaacagacuuuacugaugaucgauaauaccacaugcacuaccgugguucuaggaaacauuaucauuucccucccaaaauaccugggcucuaucaaacuucagguguugagggcccugcuccugggccaucagagcauacaaacaaaaguagacaucucaagucagauuuccagcaugaaucagucucuucagcaaucaaaggauuacaucaaagaggcucagaagauucuggacaccgucaacccgaguuugaucagcaugcucuccaugauaauucuguauguguuaucuaucgccgcacuguguauugggcuaaucacuuucauaucguuuguuaucguggaaaagaaacggggaaauuacagccgccucgaugaccgacaggucagacccguguccaacggugaucuguauuacauuggcacguga

SEQ ID NO: 922 - RNA, 1653 nt, Artificial Sequence
  derived and/or modified CDS sequence (opt3) from Nipah henipavirus__AAK50554__HsIgE(1-18)_G(70-602)
auggacuggaccuggauccuguuccucguggccgcugcaacaagaguccacagccagaauuacaccagguccacagauaaccaagccgugauuaaggacgcguuacagggcauccagcagcaaauaaaagggcuggcugauaagauuggaacugaaaucggcccaaaagucucucuaauugacaccucgucaacaaucaccaucccggccaauauuggucuccuggggagcaagauaagucaguccacugcaucuaucaacgagaaugugaacgaaaagugcaaauucacacuucccccucugaagauucacgaguguaauaucagcugcccaaaccccuugccuuuucgggaguaucgcccacagaccgaaggaguuuccaaucucgugggccugcccaacaauauaugucugcagaaaacgucaaaccaaauucucaagccuaaauuaaucaguuacacucugccagucgugggccagagcgggaccugcaucacagauccgcuuuuggccauggacgagggauauuucgcuuacucucaucuggaacgaauugguuccuguucacguggcguaagcaagcagagaaucauugggguuggagaggugcuagauaggggcgacgagguccccagucucuuuaugacuaacguguggaccccuccaaaucccaacacaguguaucacugcucugcagucuacaauaacgaguucuacuauguucugugugccguguccaccguaggugauccuauacuuaauagcacguacuggucggggucucugaugaugacucgguuggcugugaaaccaaaguccaacggaggcggcuauaaucagcaucaacucgcccugcgcucaaucgaaaaggggagauacgacaaagucaugcccuauggaccgagugguauuaagcagggcgauacauuauacuuuccugcggugggguuccugguuaggaccgaauuuaaauauaacgacagcaauugccccaucacuaagugucaguacuccaaaccagagaacugccggcucucuaugggaauccgcccuaauagccacuacauucuucgaucaggccuguugaaguauaaccuaagugacggugaaaaucccaagguggucuucauagagaucuccgaucaaagacugagcauugggucuccaucaaaaaucuacgacagucucggccagcccguguuuuaucaggccagcuucuccugggauacaaugauuaaguuuggagacguacugaccguuaacccucuuguggucaauuggaggaacaacacggugaucucucggccaggccagucgcaauguccgcguuucaauaccugccccgagauaugcugggaaggggucuacaacgaugcauuccugaucgaccgcauuaauuggaucagcgcuggaguguuuuuggauuccaaccagacagccgagaauccuguuuucacuguguuuaaagacaacgaaauucucuauagagcacagcuggcuucagaggauaccaaugcccagaagacaaucacuaacuguuucuuacugaaaaauaagauauggugcauuagucuaguagaaaucuacgacaccggugauaacgucauuaggccaaagcucuuugcggugaaaauccccgagcaauguacauga

SEQ ID NO: 923 - RNA, 1653 nt, Artificial Sequence
  derived and/or modified CDS sequence (opt3) from Nipah henipavirus__AEZ01389__HsIgE(1-18)_G(70-602)
auggacuggaccuggauccuguuccucguggccgcugcaacaagaguccacagccagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccauucuuaauuccaccuacuggucagguagucugaugaugacgagauuggcugugaagccuaaaaacaauggggaaagcuauaaccagcaucaauuugcccucaggaauauagaaaagggaaaauacgacaaggucaugccauauggccccuccggcaucaaacagggggauacucuguacuucccggcggugggauuuuuaguucggacagaguucaaguauaacgacucuaauugcccuauugcagaaugucaguacagcaagcccgagaacugccgccugucaauggguaucagaccaaauagucacuacauccucagguccggccuucugaaauauaacuugagcgacgaggaaaauucuaagauuguguuuauagagaucucagaucaacggcuaaguauugggagcccuuccaaaaucuacgacucucugggacagcccgucuucuaucaggccucguuuagcugggauaccaugauuaaguucggcgacgugcagacuguaaacccacucguugugaacuggcgcgauaauacagucaucucccgacccggucaaucacaguguccuagauucaacaaaugcccagaagugugcugggagggggucuacaaugacgcuuuucugauagauaggaucaacuggauuagugccggcguguuccuugacucuaaucagaccgcagaaaacccgguuuuuacgguguucaaggauaaugagguacuguaucgggcucaguuggccagcgaggacaccaacgcgcaaaagacaaucacuaauuguuuucuccugaaaaacaagauuuggugcaucuccuuagucgaaauauacgauaccggagacaaugugauucgucccaaacuguucgccguuaagaucccugagcaguguacauga

SEQ ID NO: 924 - RNA, 1653 nt, Artificial Sequence
  derived and/or modified CDS sequence (opt3) from Nipah henipavirus__ACT32615__HsIgE(1-18)_G(70-602)
auggacuggaccuggauccuguuccucguggccgcugcaacaagaguccacagccagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccgugcuuaauuccaccuacuggucagguagucugaugaugacgagauuggcugucaagccuaaaaacaauggggaaagcuauaaccagcaucaauuugcccucaggaauauugaaaagggaaaauacgacaaggugaugccauauggccccuccggcauaaaacagggggauacucuguacuucccggcgguuggauuuuuagugcggacagaguucaaguauaacgacucuaauugcccuaucgcagaaugucaguacagcaagcccgagaacugccgccugucaauggguauuagaccaaauagucacuacauccucagguccggccuucugaaauauaacuugagcgacgaggaaaauucuaagaucgucuuuauugagauaucagaucaacggcuaaguaucgggagcccuuccaaaauuuacgacucucugggacagcccguguucuaucaggccucguuuagcugggauaccaugaucaaguucggcgacguacagacuguuaacccacucguggucaacuggcgcgauaauacagugauuucccgacccggucaaucacaguguccuagauucaacaaaugcccagaagucugcugggaggggguguacaaugacgcuuuucugaucgauaggauaaacuggaucagugccggcguuuuccuugacucuaaucagaccgcagaaaacccgguguuuacgguauucaaggauaaugagguccuguaucgggcucaguuggccagcgaggacaccaacgcgcaaaagacaauuacuaauuguuuucuccugaaaaacaagaucuggugcauuuccuuaguggaaaucuacgauaccggagacaauguuauacgucccaaacuguucgccgugaagauuccugagcaguguacauga

SEQ ID NO: 925 - RNA, 1653 nt, Artificial Sequence
  derived and/or modified CDS sequence (opt3) from Nipah henipavirus__CAF25497__HsIgE(1-18)_G(70-602)
auggacuggaccuggauccuguuccucguggccgcugcaacaagaguccacagccagaacuacaccagguccacagauaaucaagccgugaucaaggacgcguuacagggcauucagcagcaaaucaaagggcuggcugauaagauaggaacugaaauuggcccaaaagucucucuaaucgacaccucgucaacaauuaccaucccggccaacaucggucuccuggggagcaagauuagucaguccacugcaucuauaaaugagaacgugaaugaaaagugcaaauucacacuucccccucugaagauccacgaguguaacauuagcugcccaaaucccuugccuuuucgggaguaucgcccacagaccgaaggaguuuccaaccucgugggccugcccaauaacaucugucugcagaaaacgucaaaccaaauacucaagccuaaauuaauuaguuacacucugccagucgugggccagagcgggaccugcaucacagauccgcuuuuggccauggacgagggauauuucgcuuacucucaucuggaacgaaucgguuccuguucacguggcguaagcaagcagagaauuaucgggguuggagaggugcuagauaggggcgacgagguccccagucucuuuaugacuaaugugugggcaccuccaaaccccaauaccguguaucacugcucugccgucuacaacaaugaguucuacuauguucugugugcuguguccacaguaggugauccuauucuuaacagcaccuacuggucggggucucugaugaugacgcgguuggccgugaaaccaaaguccaauggaggcggcuauaaccagcaucaacucgcgcugcgcucaauagaaaaggggagauacgacaaagucaugcccuauggaccgagugguaucaagcagggcgauacuuuauacuuuccugcagugggguuccugguuaggacagaauuuaaauauaaugacagcaacugccccauuaccaagugucaguacuccaaaccagagaauugccggcucucuaugggaauccgcccuaacagccacuacauccuucgaucaggccuguugaaguauaaucuaagugacggugaaaaccccaagguggucuucauugagauauccgaucaaagacugagcaucgggucuccaucaaaaauuuacgacagucucggccagcccguguuuuaucaggccagcuucuccugggauacuaugaucaaguuuggagacguacugacaguuaauccucuuguggucaacuggaggaacaauaccgugauuucucggccaggccagucgcaauguccgcguuucaacacgugccccgagaucugcugggaaggggucuacaaugaugcuuuccugauagaccgcaucaacuggauuagcgccggaguguuuuuggauuccaaucagaccgcagagaacccuguuuucacaguguuuaaagacaaugaaauccucuauagagcucagcuggccucagaggauacuaacgcgcagaagaccauuacaaauuguuucuuacugaaaaacaagaucuggugcauaagucuaguagaaauuuacgacacuggugauaaugucaucaggccaaagcucuuugccgugaaaauucccgagcaauguaccuga

SEQ ID NO: 926 - RNA, 1653 nt, Artificial Sequence
  derived and/or modified CDS sequence (opt3) from Nipah henipavirus__CBM41034__HsIgE(1-18)_G(70-602)
auggacuggaccuggauccuguuccucguggccgcugcaacaagaguccacagccagaacuacaccagguccacagauaaucaagccgugaucaaggacgcguuacagggcauucagcagcaaaucaaagggcuggcugauaagauaggaacugaaauuggcccaaaagucucucuaaucgacaccucgucaacaauuaccaucccggccaacaucggucuccuggggagcaagauuagucaguccacugcaucuauaaaugagaacgugaaugaaaagugcaaauucacacuucccccucugaagauccacgaguguaacauuagcugcccaaaucccuugccuuuucgggaguaucgcccacagaccgaaggaguuuccaaccucgugggccugcccgauaauaucugucugcagaaaacgucaaaccaaauacucaagccuaaauuaauuaguuacacucugccagucgugggccagagcgggaccugcaucacagacccgcuuuuggccauggaugagggauauuucgcuuacucucaucuggaacgaaucgguuccuguucacguggcguaagcaagcagagaauuaucgggguuggagaggugcuagacaggggcgaugagguccccagucucuuuaugacuaacguguggaccccuccaaaucccaacacaguguaucacugcucugcagucuacaauaacgaguucuacuauguucugugugccguguccaccguaggugacccuauucuuaauagcacguacuggucggggucucugaugaugacucgguuggcugugaaaccaaaguccaacggaggcggcuauaaucagcaucaacucgcccugcgcucaauagaaaaggggagauacgauaaagucaugcccuauggaccgagugguaucaagcagggcgacacauuauacuuuccugcggugggguuccugguuaggaccgaauuuaaauauaacgacagcaauugccccauuacuaagugucaguacuccaaaccagagaacugccggcucucuaugggaauccgcccuaauagccacuacauccuucgaucaggccuguugaaguauaaccuaagugauggugaaaaucccaagauuguguucauagagaucuccgaccaaagacugagcauugggucuccaucaaaagucuacgauagucucggccagcccguguuuuaucaggccagcuucuccugggacacaaugaucaaguuuggagauguacagaccguuaacccucugguggucaauuggagggacaacacggugauuucucggccaggccaaucgcaguguccgcguuucaauaccugccccgagaucugcugggaaggggucuacaacgaugcauuccuuauagaccgcaucaacuggauuagcgcuggaguguuucuggauuccaaucagacagccgagaacccuguuuucacuguguuuaaagacaaugaaaucuuguauagagcacagcucgcuucagaggauaccaacgcccaaaagacaauuacuaauuguuuccugcugaaaaacaagaucuggugcauaaguuuaguagaaauuuacgacaccggugacaaugucaucaggccaaagcuauuugcggugaaaauucccgagcaguguacauga

SEQ ID NO: 927 - RNA, 1653 nt, Artificial Sequence
  derived and/or modified CDS sequence (opt3) from Nipah henipavirus__AAX51853__HsIgE(1-18)_G(70-602)
auggacuggaccuggauccuguuccucguggccgcugcaacaagaguccacagccagaacuacaccaggucuacagauaaucaagccguaaucaaggacgcguuacagggcauacagcagcaaauuaaagggcuggcugauaagaucggaacugaaauuggcccaaaagugucgcuaaucgacaccucaagcacaaucaccauuccggccaacauaggucuccuggggaguaagaucucccagucuacugcaagcauuaaugagaacgucaaugaaaagugcaaauucacacuucccccucugaagauccacgaguguaacauauccugcccaaaucccuugccuuuucgggaguaucgcccacagaccgaaggagugucaaaccucguuggccugcccaauaacauuugucugcagaaaacgaguaaucaaauccucaagccuaaauuaaucagcuacacucugccaguggucggccagucugggaccugcauuacagauccgcuuuuggccauggacgagggauauuucgcuuacucccaucuggaacgaaucgguucauguagccguggcgugaguaagcagaaaauuauagggguaggagagguucuagauagaggcgacgaggugcccucucucuuuaugacuaacgucuggaccccuccaaaccccaauacaguguaucacugcuccgcaguguacaacaaugaguucuacuauguccugugugccguuagcaccgugggugauccuauccuuaacucgacguacuggucugggucccugaugaugacuagguuggcuguaaagccaaagucaaaugacggaggcuauaaccagcaucaacucgcccugcggaguauugaaaaaggccgcuacgauaaggugaugcccuaugggccgagcggaaucaaacagggugacacauuauacuuuccugcggucggcuuccuggugagaaccgaauuuaaguauaaugacuccaacugccccaucacuaaaugucaguacucuaagccagagaauugcaggcucagcauggggauucggccuaacucacacuacguucuucgcaguggacuguugaaguauaaucuauccgauggcgaaaaccccaaaauaguguucaucgagauuagcgaccaacgacugucuaucgguucaccaaguaagauuuacgauagccucgggcagcccgucuuuuaucaggcauccuucucuugggacacaaugaucaaauuuggcgaugugcagaccguaaauccucugguugugucguggagagacaacacggucauaagcaggccaggacaaucccaguguccgcgguucaauaccugccccgagaucugcugggaaggcguguacaacgaugccuuccuuauugaccguaucaacuggauuucagcuggggucuuucuggauaguaaucagacagccgagaacccuguguucacuguuuuuaaggacaaugaaaucuuguaucgcgcacagcucgcuucugaggauaccaacgcccagaaaacaauaacuaauuguuuccuguuaaagaacaagauuuggugcaucagccugguggaaauuuacgacaccggagacaauguaaucagaccaaaacuauuugcggucaagauacccgagcaauguacauga

SEQ ID NO: 928 - RNA, 1653 nt, Artificial Sequence
  derived and/or modified CDS sequence (opt3) from Nipah henipavirus__AEZ01397__HsIgE(1-18)_G(70-602)
auggacuggaccuggauccuguuccucguggccgcugcaacaagaguccacagccagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccauucuuaauuccaccuacuggucagguagucugaugaugacgagauuggcugugaagccuaaaaacaauggggaaagcuauaaccagcaucaauuugcccucaggaauauagaaaagggaaaauacgacaaggucaugccauauggccccuccggcaucaaacagggggauacucuguacuucccggcggugggauuuuuaguucggacagaguucaccuauaacgacucuaauugcccuauugcagaaugucaguacagcaagcccgagaacugccgccugucaauggguaucagaccaaauagucacuacauccucagguccggccuucugaaguauaacuugagcgacgaggaaaauucuaaaauuguguuuauagagaucucagaucaacggcuaaguauugggagcccuuccaagaucuacgacucucugggacagcccgucuucuaucaggccucguuuagcugggauacuaugauuaaauucggcgacgugcagacaguaaacccacucguugugaacuggcgcgauaauaccgucaucucccgacccggucaaucacaguguccuagauucaacaagugcccagaagugugcugggagggggucuacaaugacgcuuuucugauagauaggaucaacuggauuagugccggcguguuccuugacucuaaucagacggcagaaaacccgguuuuuaccguguucaaagauaaugagguacuguaucgggcucaguuggccagcgaggacacaaacgcgcaaaagacuaucaccaauuguuuucuccugaagaacaaaauuuggugcaucuccuuagucgaaauauacgauacaggagacaaugugauucgucccaagcuguucgccguuaaaaucccugagcaguguacuuga

SEQ ID NO: 929 - RNA, 1659 nt, Artificial Sequence
  derived and/or modified CDS sequence (opt3) from Hendra henipavirus__NP_047112__HsIgE(1-18)_G(70-604)
auggacuggaccuggauccuguuccucguggccgcugcaacaagaguccacagccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauagccaucacaaaggucgaaagagggaaauacgauaagguuaugccuuauggaccauccggcauuaaacaaggcgacacccucuacuuucccgcugugggguuccuuccgaggacggaguuucaguauaaugauucuaacugcccuaucauucacuguaaguacagcaaagccgagaauugccggcugucaaugggaguaaacaguaagucccacuauaucuugcgcagcggucuacugaaguacaaucucucucugggcggggacauaauccuucaguucauugaaaucgcggauaaccgacugaccauuggaucacccaguaaaaucuacaauagcuugggccaaccaguguuuuaucaggcauccuacucuugggacacaaugauaaagcucggugaugucgacacuguggauccucugagaguucaguggaggaacaauucggugauuagccggcccgggcagucccaauguccacguuucaacgucugccccgaggugugcugggaaggcaccuauaaugacgccuuuuuaaucgaccgccugaacuggguaucagcuggaguuuaccuaaacaguaaucagacagccgagaacccuguguucgcagucuucaaagauaaugaaauucucuaucaggugccacuggcugaggacgauacuaacgcccagaagaccaucacagacuguuuucuuuuggagaaugucauauggugcaucucucugguggaaauuuacgauaccggcgacagcguuaucagaccgaaacucuucgcggugaagauucccgcccaauguuccgagucauga

SEQ ID NO: 930 - RNA, 1659 nt, Artificial Sequence
  derived and/or modified CDS sequence (opt3) from Hendra henipavirus__AEB21225__HsIgE(1-18)_G(70-604)
auggacuggaccuggauccuguuccucguggccgcugcaacaagaguccacagccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauagccaucacaaaggucgaaagagggaaauacgauaagguuaugccuuauggaccauccggcauuaaacaaggcgacacccucuacuuucccgcugugggguuccuuccgaggacggaguuucaguauaaugauucuaacugcccuaucauucacuguaaguacagcaaagccgagaauugccggcugucaaugggaguaaacaguaagucccacuauaucuugcgcagcggucuacugaaguacaaucucucucugggcggggacauaacccuucaguucaucgaaauugcggauaaccgacugacaaucggaucacccaguaaaauuuacaauagcuugggccaaccaguguuuuaucaggcauccuacucuugggacacuaugaucaagcucggugaugucgacaccguggauccucugagaguucaguggaggaacaauucggugauaagccggcccgggcagucccaauguccacguuucaacgucugccccgaggugugcugggaaggcacauauaaugacgccuuuuuaauugaccgccugaacuggguaucagcuggaguuuaccuaaacaguaaucagacugccgagaacccuguguucgcagucuucaaagauaaugaaauccucuaucaggugccacuggcugaggacgauaccaacgcccagaagacaauuaccgacuguuuucuuuuggagaaugucaucuggugcauaucucugguggaaaucuacgauacuggcgacagcguuauuagaccgaaacucuucgcggugaagauccccgcccaauguuccgagucauga

SEQ ID NO: 931 - RNA, 1659 nt, Artificial Sequence
  derived and/or modified CDS sequence (opt3) from Hendra henipavirus__AEB21216__HsIgE(1-18)_G(70-604)
auggacuggaccuggauccuguuccucguggccgcugcaacaagaguccacagccaaaauuacacuagaacgaccgauaaccaggcccuaaucaaagagagccuccaguccguacagcaacagauaaaggcgcugacagacaaaauuggaacugaaaucggcccuaaggugucucuuauugauaccucgucaacaaucaccaucccagcuaauauuggucuguuggggagcaaaauaagucaguccacuucuagcaucaacgagaaugucaacgacaagugcaaguuuacacucccgccccugaaaauucacgaauguaauaucuccugcccuaacccacugcccuucagggaguaucggccuauaucacagggagugagugaucucguuggcuuaccaaaucaaauuugucugcagaagaccacgagcacuauccuuaaaccccgcuugaucucuuacacccugccuauuaacacacgagaaggcgugugcaucacugacccacuacucgccgucgauaacggguuuuucgcauauucccaucuggagaagauuggaucauguacccgugguauagccaaacagagaaucauuggcgugggggagguacuugacaggggagauaagguuccgagcauguuuaugacaaauguguggacgcccccuaacccaaguaccauccaccauuguucuuccacuuaccacgaagacuucuauuacacacugugcgcugucagccaugugggcgaccccauccucaauucgaccucuuggacugaguccuugucacugauucgguuagcagugcgcccuaaaagugauagcggugacuacaaccagaaguauauagccaucaauaaggucgaaagagggaaauacgauaagguuaugccauauggacccuccggcauuaaacaaggcgacacacuguacuuuccggcugugggguuccucccuaggaccgaguuucaguauaacgauucuaauugccccaucauucacuguaaguacagcaaagccgagaacugccggcuuucaaugggaguaaauaguaagucccacuauauccugcgcagcgguuugcuaaaguacaaccugucucucggcggggacauaauccugcaguucauugaaaucgcggauaaucgacuuacgauuggaucaccaaguaaaaucuacaacagccugggccaaccuguguuuuaucaggcauccuacucuugggacaccaugauaaaguugggugaugucgacacaguggauccccucagaguucaguggaggaauaacucggugauuagccggccagggcagucccaauguccccguuucaaugucugcccugaggugugcugggaaggcacuuauaacgacgccuuucugaucgaccgcuuaaacuggguaucagcuggaguuuaccugaauaguaaccagaccgccgagaauccaguguucgcagucuucaaagauaacgaaauucuauaucaggugccgcucgcugaggacgauacaaaugcccagaagacuaucaccgacuguuuucugcuugagaacgucauauggugcaucucuuugguggaaauuuacgauacaggcgacagcguuaucagacccaaacuguucgcggugaagauuccugcccaauguuccgagucauga

SEQ ID NO: 932 - RNA, 1659 nt, Artificial Sequence
  derived and/or modified CDS sequence (opt3) from Hendra henipavirus__AEB21206__HsIgE(1-18)_G(70-604)
auggacuggaccuggauccuguuccucguggccgcugcaacaagaguccacagccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcgguaacuacaaucagaaguauauagccaucacaaaggucgaaagagggaaauacgacaagguuaugccuuauggaccauccggcauuaaacaaggcgauacccucuacuuucccgcugugggguuccuuccgaggacggaguuucaguauaacgacucuaauugcccuaucauucacuguaaguacagcaaagccgagaacugccggcugucaaugggaguaaauaguaagucccacuauaucuugcgcagcggucuacugaaguacaaccucucucugggcggggauauaauccuucaguucauugaaaucgcggacaaucgacugaccauuggaucacccaguaaaaucuacaacagcuugggccaaccaguguuuuaucaggcauccuacucuugggauacaaugauaaagcucggugacauugauacugucgacccucugagagugcaguggaggaauaacucgguuaucagccggcccgggcagucccaauguccacguuucaaugugugccccgaggucugcugggaaggcaccuauaacgaugccuuuuuaauugaccgccugaacugggugucagcuggaguauaccuaaauaguaaccagacagccgagaauccuguuuucgcaguguucaaagacaacgaaauccucuaucaggucccacuggcugaggaugacacuaaugcccagaagaccauaacagauuguuuucuuuuggagaacgugaucuggugcauuucucuggucgaaaucuacgacaccggcgauagcgugauuagaccgaaacucuucgcgguuaagauccccgcccaauguuccgagucauga

SEQ ID NO: 933 - RNA, 1659 nt, Artificial Sequence
  derived and/or modified CDS sequence (opt3) from Hendra henipavirus__AEQ38052__HsIgE(1-18)_G(70-604)
auggacuggaccuggauccuguuccucguggccgcugcaacaagaguccacagccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauaacaaucaccaaggucgaaagagggaaauacgauaagguuaugccuuauggaccauccggcauuaaacaaggcgacacgcucuacuuucccgccgugggguuccuuccgaggaccgaguuucaguauaaugauucuaacugcccuaucauucacuguaaguacagcaaagcugagaauugccggcugucaaugggaguaaacaguaagucccacuauaucuugcgcagcggucuacugaaguacaaucucucucugggcggggacauaauccuucaguucauugaaaucgccgauaaccgacugacaauuggaucacccaguaaaaucuacaauagcuugggccaaccaguguuuuaucaggcguccuacucuugggacacuaugauaaagcucggugaugucgacaccguggauccucugagaguucaguggaggaacaauucggugauuagccggcccgggcagucccaauguccacguuucaacgucugccccgaggugugcugggaaggcacauauaaugacgcauuuuuaaucgaccgccugaacuggguaucagccggaguuuaccuaaacaguaaucagacugcugagaacccuguguucgccgucuucaaagauaaugaaauucucuaucaggugccacuggcagaggacgauaccaacgcucagaagacaaucaccgacuguuuucuuuuggagaaugucauauggugcaucucucugguggaaauuuacgauacuggcgacagcguuaucagaccgaaacucuucgccgugaagauucccgcgcaauguuccgagucauga

SEQ ID NO: 934 - RNA, 1659 nt, Artificial Sequence
  derived and/or modified CDS sequence (opt3) from Hendra henipavirus__AEQ38115__HsIgE(1-18)_G(70-604)
auggacuggaccuggauccuguuccucguggccgcugcaacaagaguccacagccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauaacggugacuacaaucagaaguauauagccaucacaaaggucgaaagagggaaauacgauaagguuaugccuuauggaccaagcggcauuaaacaaggcgacacccucuacuuucccgcugugggguuccuuccgaggacggaguuucaguauaacgauuccaauugcccuaucauucacuguaaguacucuaaagccgagaacugccggcugagcaugggaguaaauucaaagagucacuauaucuugcgcuccggucuacugaaguacaaccucagccugggcggggacauaauccuucaguucauugaaaucgcggauaaucgacugaccauuggaucucccucaaaaaucuacaacaguuugggccaaccaguguuuuaucaggcaagcuacuccugggacacaaugauaaagcucggugaugucgacacuguggauccucugagaguucaguggaggaauaacucugugauuucgcggcccgggcagagccaauguccacguuucaaugucugccccgaggugugcugggaaggcaccuauaacgacgccuuuuuaaucgaccgccugaacuggguauccgcuggaguuuaccuaaauucaaaccagacagccgagaauccuguguucgcagucuucaaagauaacgaaauucucuaucaggugccacuggcugaggacgauacuaaugcccagaagaccaucacagacuguuuucuuuuggagaacgucauauggugcaucagucugguggaaauuuacgauaccggcgacucuguuaucagaccgaaacucuucgcggugaagauucccgcccaauguagcgaguccuga

SEQ ID NO: 935 - RNA, 1659 nt, Artificial Sequence
  derived and/or modified CDS sequence (opt3) from Hendra henipavirus__AEQ38108__HsIgE(1-18)_G(70-604)
auggacuggaccuggauccuguuccucguggccgcugcaacaagaguccacagccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauaacaaucaccaaggucgaaagagggaaauacgauaagguuaugccuuauggaccauccggcauuaaacaaggcaauacgcucuacuuucccgccgugggguuccuuccgaggaccgaguuucaguauaacgacucuaauugcccuaucauucacuguaaguacagcaaagcugagaacugccggcugucaaugggaguaaauaguaagucccacuauaucuugcgcagcggucuacugaaguacaaccucucucugggcggggauauaauccuucaguucauugaaaucgccgacaaucgacugacaauuggaucacccaguaaaaucuacaacagcuugggccaaccaguguuuuaucaggcguccuacucuugggauacuaugauaaagcucggugacgucgauaccguggacccucugagaguucaguggaggaauaacucggugauuagccggcccgggcagucccaauguccacguuucaaugucugccccgaggugugcugggaaggcacauauaacgaugcauuuuuaaucgaccgccugaacuggguaucagccggaguuuaccuaaauaguaaccagacugcugagaauccuguguucgccgucuucaaagacaacgaaauucucuaucaggugccacuggcagaggaugacaccaaugcucagaagacaaucaccgauuguuuucuuuuggagaacgucauauggugcaucucucugguggaaauuuacgacacuggcgauagcguuaucagaccgaaacucuucgccgugaagauucccgcgcaauguuccgagucauga

SEQ ID NO: 936 - RNA, 1659 nt, Artificial Sequence
  derived and/or modified CDS sequence (opt3) from Hendra henipavirus__AAV80426__HsIgE(1-18)_G(70-604)
auggacuggaccuggauccuguuccucguggccgcugcaacaagaguccacagccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucagugcacuuccucuaucaacgagaaugucaacgacaaguguaaguuuacacugccaccgcugaaaauucacgaaugcaauaucagcugucccaacccucucccauucagggaguaucggcccauaucccagggagugucagauuuaguuggccugccuaaucaaauuugccuucagaagaccacgaguacuaucuugaaaccacgccugaucagcuacacccuacccauuaacacacgagaaggcguguguaucacugacccucuccuggccgucgauaacggguuuuucgcauauucucaucuugagaagauuggauccugcacccgugguauagccaaacagagaaucauuggcgugggggagguacuggacaggggagauaagguuccaucaauguuuaugacaaauguguggaccccgcccaacccuagcacgauccaccauuguaguucuacuuaccacgaagacuucuauuacacauugugcgcugucucccaugugggcgacccaauccucaauagcaccucguggacugagucucuguccuuaauucggcuggcagugcgccccaaaucagauaguggugacuacaaccagaaguauauagccaucacaaaggucgaaagagggaaauacgauaagguuaugccuuauggaccaagcggcauuaaacaaggcgacacccucuacuuucccgcugugggguuccuuccgaggacggaguuucaguauaaugauuccaacuguccuaucauucacugcaaguacucuaaagccgagaauugucggcugagcaugggaguaaacucaaagagucacuauaucuugcgcuccggucuacugaaguacaaucucagccugggcggggacauaauccuucaguucauugaaaucgcggauaaccgacugaccauuggaucucccucaaaaaucuacaauaguuugggccaaccaguguuuuaucaggcaagcuacuccugggacacaaugauaaagcucggugaugucgacacuguggauccucugagaguucaguggaggaacaauucugugauuucgcggcccgggcagagccaaugcccacguuucaacgucugccccgagguguguugggaaggcuccuauaaugacgccuuuuuaaucgaccgccugaacuggguaucagcuggaguuuaccuaaacaguaaucagaccgccgagaacccuguguucgcagucuucaaagauaaugaaauucucuaucaggugccacuggcugaggacgauacaaacgcccagaagacuaucaccgacugcuuucuuuuggagaaugucauaugguguaucucucugguggaaauuuacgauacaggcgacagcguuaucagaccgaaacucuucgcggugaagauucccgcccaaugcuccgagucauga

SEQ ID NO: 937 - RNA, 1617 nt, Artificial Sequence
  derived and/or modified CDS sequence (opt4) from Nipah henipavirus__AAK50553__HsIgE(1-18)_F(27-546)
auggacuggaccuggauccuguuccugguggccgccgccaccagagugcacagcauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 938 - RNA, 1617 nt, Artificial Sequence
  derived and/or modified CDS sequence (opt4) from Nipah henipavirus__AEZ01388__HsIgE(1-18)_F(27-546)
auggacuggaccuggauccuguuccugguggccgccgccaccagagugcacagcauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 939 - RNA, 1617 nt, Artificial Sequence
  derived and/or modified CDS sequence (opt4) from Nipah henipavirus__AAY43915__HsIgE(1-18)_F(27-546)
auggacuggaccuggauccuguuccugguggccgccgccaccagagugcacagcauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguacagcagcgaccugcuguucguguucggccccaaccugcaggaccccgugagcaacagcaugaccauccaggccaucagccaggccuucggcggcaacuacgagacccugcugagaacccugggcuacgccaccgagggcuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 940 - RNA, 1617 nt, Artificial Sequence
  derived and/or modified CDS sequence (opt4) from Nipah henipavirus__CAF25496__HsIgE(1-18)_F(27-546)
auggacuggaccuggauccuguuccugguggccgccgccaccagagugcacagcauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaucgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 941 - RNA, 1617 nt, Artificial Sequence
  derived and/or modified CDS sequence (opt4) from Nipah henipavirus__AAM13405__HsIgE(1-18)_F(27-546)
auggacuggaccuggauccuguuccugguggccgccgccaccagagugcacagcauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaccaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 942 - RNA, 1617 nt, Artificial Sequence
  derived and/or modified CDS sequence (opt4) from Nipah henipavirus__CBM41033__HsIgE(1-18)_F(27-546)
auggacuggaccuggauccuguuccugguggccgccgccaccagagugcacagcauccugcacuacgagaagcugagcaagaucggccuggugaagggcgugaccagaaaguacaagaucaagagcaacccccugaccaaggacaucgugaucaagaugaucgccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaagagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 943 - RNA, 1617 nt, Artificial Sequence; identical to SEQ ID NO: 938
  derived and/or modified CDS sequence (opt4) from Nipah henipavirus__AEZ01396__HsIgE(1-18)_F(27-546)

SEQ ID NO: 944 - RNA, 1617 nt, Artificial Sequence
  derived and/or modified CDS sequence (opt4) from Hendra henipavirus__NP_047111__HsIgE(1-18)_F(27-546)
auggacuggaccuggauccuguuccugguggccgccgccaccagagugcacagcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucgccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 945 - RNA, 1617 nt, Artificial Sequence
  derived and/or modified CDS sequence (opt4) from Hendra henipavirus__AEB21233__HsIgE(1-18)_F(27-546)
auggacuggaccuggauccuguuccugguggccgccgccaccagagugcacagcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 946 - RNA, 1620 nt, Artificial Sequence
  derived and/or modified CDS sequence (opt4) from Hendra henipavirus__AEQ38114__HsIgE(1-18)_F(26-546)
auggacuggaccuggauccuguuccugguggccgccgccaccagagugcacagcggcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucaucaucguggagaagaagagaggcaacuacagcagacuggacgacagacaggugagacccgugagcaacggcgaccuguacuacaucggcaccuga

SEQ ID NO: 947 - RNA, 1617 nt, Artificial Sequence
  derived and/or modified CDS sequence (opt4) from Hendra henipavirus__AAB39505__HsIgE(1-18)_F(27-546)
auggacuggaccuggauccuguuccugguggccgccgccaccagagugcacagcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugcugaucugcagcugcuucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcagagagcagacccugcugaugaucgacaacaccaccugcaccaccguggugcugggcaacaucaucaucagccugcccaaguaccugggcagcaucaagcugcaggugcugagagcccugcugcugggccaccagagcauccagaccaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 948 - RNA, 1653 nt, Artificial Sequence
  derived and/or modified CDS sequence (opt4) from Nipah henipavirus__AAK50554__HsIgE(1-18)_G(70-602)
auggacuggaccuggauccuguuccugguggccgccgccaccagagugcacagccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaaggugguguucaucgagaucagcgaccagagacugagcaucggcagccccagcaagaucuacgacagccugggccagcccguguucuaccaggccagcuucagcugggacaccaugaucaaguucggcgacgugcugaccgugaacccccugguggugaacuggagaaacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 949 - RNA, 1653 nt, Artificial Sequence
  derived and/or modified CDS sequence (opt4) from Nipah henipavirus__AEZ01389__HsIgE(1-18)_G(70-602)
auggacuggaccuggauccuguuccugguggccgccgccaccagagugcacagccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccauccugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaaguacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 950 - RNA, 1653 nt, Artificial Sequence
  derived and/or modified CDS sequence (opt4) from Nipah henipavirus__ACT32615__HsIgE(1-18)_G(70-602)
auggacuggaccuggauccuguuccugguggccgccgccaccagagugcacagccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccgugcugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaaguacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 951 - RNA, 1653 nt, Artificial Sequence
  derived and/or modified CDS sequence (opt4) from Nipah henipavirus__CAF25497__HsIgE(1-18)_G(70-602)
auggacuggaccuggauccuguuccugguggccgccgccaccagagugcacagccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacgugugggccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaaggugguguucaucgagaucagcgaccagagacugagcaucggcagccccagcaagaucuacgacagccugggccagcccguguucuaccaggccagcuucagcugggacaccaugaucaaguucggcgacgugcugaccgugaacccccugguggugaacuggagaaacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 952 - RNA, 1653 nt, Artificial Sequence
  derived and/or modified CDS sequence (opt4) from Nipah henipavirus__CBM41034__HsIgE(1-18)_G(70-602)
auggacuggaccuggauccuguuccugguggccgccgccaccagagugcacagccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccgacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaagaucguguucaucgagaucagcgaccagagacugagcaucggcagccccagcaagguguacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 953 - RNA, 1653 nt, Artificial Sequence
  derived and/or modified CDS sequence (opt4) from Nipah henipavirus__AAX51853__HsIgE(1-18)_G(70-602)
auggacuggaccuggauccuguuccugguggccgccgccaccagagugcacagccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagaagaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacgacggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacgugcugagaagcggccugcugaaguacaaccugagcgacggcgagaaccccaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugagcuggagagacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 954 - RNA, 1653 nt, Artificial Sequence
  derived and/or modified CDS sequence (opt4) from Nipah henipavirus__AEZ01397__HsIgE(1-18)_G(70-602)
auggacuggaccuggauccuguuccugguggccgccgccaccagagugcacagccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccauccugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaccuacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 955 - RNA, 1659 nt, Artificial Sequence
  derived and/or modified CDS sequence (opt4) from Hendra henipavirus__NP_047112__HsIgE(1-18)_G(70-604)
auggacuggaccuggauccuguuccugguggccgccgccaccagagugcacagccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 956 - RNA, 1659 nt, Artificial Sequence
  derived and/or modified CDS sequence (opt4) from Hendra henipavirus__AEB21225__HsIgE(1-18)_G(70-604)
auggacuggaccuggauccuguuccugguggccgccgccaccagagugcacagccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucacccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 957 - RNA, 1659 nt, Artificial Sequence
  derived and/or modified CDS sequence (opt4) from Hendra henipavirus__AEB21216__HsIgE(1-18)_G(70-604)
auggacuggaccuggauccuguuccugguggccgccgccaccagagugcacagccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaacaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 958 - RNA, 1659 nt, Artificial Sequence
  derived and/or modified CDS sequence (opt4) from Hendra henipavirus__AEB21206__HsIgE(1-18)_G(70-604)
auggacuggaccuggauccuguuccugguggccgccgccaccagagugcacagccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcaacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacaucgacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 959 - RNA, 1659 nt, Artificial Sequence
  derived and/or modified CDS sequence (opt4) from Hendra henipavirus__AEQ38052__HsIgE(1-18)_G(70-604)
auggacuggaccuggauccuguuccugguggccgccgccaccagagugcacagccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucaccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 960 - RNA, 1659 nt, Artificial Sequence
  derived and/or modified CDS sequence (opt4) from Hendra henipavirus__AEQ38115__HsIgE(1-18)_G(70-604)
auggacuggaccuggauccuguuccugguggccgccgccaccagagugcacagccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacaacggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 961 - RNA, 1659 nt, Artificial Sequence
  derived and/or modified CDS sequence (opt4) from Hendra henipavirus__AEQ38108__HsIgE(1-18)_G(70-604)
auggacuggaccuggauccuguuccugguggccgccgccaccagagugcacagccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucaccaucaccaagguggagagaggcaaguacgacaaggugaugcccuacggccccagcggcaucaagcagggcaacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 962 - RNA, 1659 nt, Artificial Sequence
  derived and/or modified CDS sequence (opt4) from Hendra henipavirus__AAV80426__HsIgE(1-18)_G(70-604)
auggacuggaccuggauccuguuccugguggccgccgccaccagagugcacagccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagugcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcagcuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 963 - RNA, 1617 nt, Artificial Sequence
  derived and/or modified CDS sequence (opt5) from Nipah henipavirus__AAK50553__HsIgE(1-18)_F(27-546)
auggacuggaccuggauccuguuccucguggccgcugccacaagaguccacagcauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgaccgaggacuuugaugaccuccuggagagcgauucuauuacaggacagaucauuuacgucgaccuguccagcuauuacaucauugugcgcguuuauuucccuauccucaccgaaauccaacaggccuacauucaggagcugcuucccguguccuuuaacaaugacaacucugaauggaucagcauugucccuaauuucauccuggugagaaacacccucauuuccaauaucgagauuggcuuuugucugaucacaaagcggagcguuaucugcaaccaggauuaugcuacgccgaugaccaauaacaugcgcgaaugucuuacagggucuaccgagaaaugccccagagagcugguggucuccagccacgugccucgguucgcccucucuaauggaguccuguuugcuaacuguauuagcgugacaugccaaugucagaccacgggccgcgccaucucccagucuggcgaacaaacacugcucaugauugacaauacaaccugccccaccgccguucuggggaacgugaucauuagccuuggaaaguaccugggcuccgucaauuacaacagcgaggggaucgcuaucggaccucccguguucaccgauaagguugacauuucuucccagaucagcucuaugaaucagucccuccagcaaagcaaagauuauauuaaggaagcgcagagacugcuggacacagugaacccgucccuuaucucuaugcucagcaugauuauccuguacguccuguccaucgccucucucugcauuggccugaucacguuuauuagcuucaucauuguggagaaaaagcggaacaccuauucccgccuugaagauagacgggugcgcccuacaagcucuggggaccuguacuauaucggaaccuga

SEQ ID NO: 964 - RNA, 1617 nt, Artificial Sequence
  derived and/or modified CDS sequence (opt5) from Nipah henipavirus__AEZ01388__HsIgE(1-18)_F(27-546)
auggacuggaccuggauccuguuccucguggccgcugccacaagaguccacagcauucuccacuacgaaaaacugagcaagaucgggcuuguuaaaggaaucacccggaaguauaaaauuaaguccaacccccugacaaaggacaucgugauuaaaaugaucccuaaugugucuaacaugagccaguguacgggcuccgucauggagaauuacaagacccgccucaacgggauucugacaccgaucaaaggagcucuggaaauuuauaagaauaacacccaugaucucgugggcgacguuagacuggccggggugaucauggcgggagucgcuaucggcauugccacagccgcucaaaucaccgccggcguggcucuuuacgaggccaugaaaaaugcggauaacauuaauaagcugaagucuagcaucgaauccacaaacgaggccguugugaaacuccaggagaccgcugaaaagacggucuaugugcugaccgcccuucaggacuacauuaauacaaaccuggugcccaccaucgauaaaaucagcugcaagcagacagagcucucucuggaccuggcucucuccaaauaccugagcgaucuucuguucgucuuugggccuaaucuccaagaccccguuucuaacuccaugaccauucaggccaucagccaggcguucggaggcaacuaugaaacgcugcuucggacacugggguacgccaccgaggauuuugacgaucuccuggagucugacuccauuacaggacagaucauuuauguggaucugagcggcuacuauaucaucgugcgcgucuacuucccuauucucaccgaaauccaacaggcuuauauucaggagcugcuucccguguccuuuaauaacgacaauucugaauggaucagcauuguuccuaacuucauccuggugagaaauacccucauuuccaacaucgagaucggguuuugucugauuacaaagcggagcgucaucugcaaucaggacuacgccacgccgaugaccaacaauaugcgcgaaugucuuacaggaucuaccgagaaaugccccagagagcuggugguuuccagccacgugccucgguucgcucucucuaacggcguccuguuugccaauuguauuagcgugacaugccaaugucagaccacgggccgcgccaucucccagucuggggaacaaacacugcucaugauugauaacacaaccugccccaccgcuguccugggaaaugugaucaucagccuuggcaaguaccugggguccguuaacuauaauagcgagggaauugcgaucggcccucccguguucaccgacaaggucgauauuucuucccagaucagcucuaugaaccagucccuccagcaaagcaaagacuacauuaaggaagcccagagacugcuggauacagugaacccgucccuuaucucuaugcucagcaugaucauucuguauguucuguccaucgcuucucucuguauugggcugaucacguuuauuagcuucaucaucguggagaaaaagcggaauaccuacucccgccuugaagacagacggguccgcccuacaagcucuggagaucuguauuacauuggcaccuga

SEQ ID NO: 965 - RNA, 1617 nt, Artificial Sequence
  derived and/or modified CDS sequence (opt5) from Nipah henipavirus__AAY43915__HsIgE(1-18)_F(27-546)
auggacuggaccuggauccuguuccucguggccgcugccacaagaguccacagcauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauacagcucugaucugcuuuucgucuuugggccuaaucugcaagaccccguuuccaacagcaugaccauccaggccauuucucaggcguucggaggcaacuaugaaacgcuccugcggacacuuggguacgccaccgagggauuugaugaccugcucgaguccgauagcaucacaggccagauuaucuauguggaccuguccggguacuauauuaucgugcgcgucuacuucccuauccugaccgaaauucaacaggcuuauauccaggagcuccugcccgugucuuuuaauaacgauaauagcgaauggauuuccaucguuccuaacuucauucuugugagaaauacccugaucagcaacauugagaucggauuuugucucaucacaaagcggucugucauuugcaaucaggacuacgccacgccgaugaccaacaauaugcgcgaaugucugacaggcuccaccgagaaaugccccagagagcuugugguuagcucucacgugccucgguucgcucugagcaacggcguccucuuugccaauuguaucuccgugacaugccaaugucagaccacggggcgcgccauuucucagagcggagaacaaacacugcugaugaucgacaacacaaccugccccaccgcuguccucggcaaugugauuaucucccuggggaaguaccuuggaagcguuaacuauaauucugagggcaucgcgauugggccucccguguucaccgauaaggucgacaucuccagccagauuucuuccaugaaccagagccugcagcaauccaaagauuacaucaaggaagcccagagacuccuggacacagugaacccgucucugauuagcaugcuuuccaugaucauccucuauguucugucuauugcuagccuguguaucggacucauuacguuuaucuccuucauuaucguggagaaaaagcggaauaccuacagccgccuggaagauagacggguccgcccuacaucuuccggcgaccuuuauuacaucggcaccuga

SEQ ID NO: 966 - RNA, 1617 nt, Artificial Sequence
  derived and/or modified CDS sequence (opt5) from Nipah henipavirus__CAF25496__HsIgE(1-18)_F(27-546)
auggacuggaccuggauccuguuccucguggccgcugccacaagaguccacagcauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgauugaggacuuugaugaccuccuggagagcgauucuaucaccggacagauuaucuacgucgaccuguccagcuauuacauuaucgugcgcguuuauuucccuauccucacagaaauucaacaggccuacauccaggagcugcuucccguguccuuuaacaaugacaacucugaauggauuagcaucgucccuaauuucauucuggugagaaacacccucaucuccaauauugagaucggcuuuugucugaucaccaagcggagcguuauuugcaaccaggauuaugcuacaccgaugacgaauaacaugcgcgaaugucuuaccgggucuacagagaaaugccccagagagcugguggucuccagccacgugccucgguucgcccucucuaauggaguccuguuugcuaacuguaucagcgugaccugccaaugucagacaaccggccgcgccauuucccagucuggcgaacaaacgcugcucaugaucgacaauacaaccugccccaccgccguucuggggaacgugauuaucagccuuggaaaguaccugggcuccgucaauuacaacagcgaggggaucgcuauuggaccucccguguucacagauaagguugacaucucuucccagauuagcucuaugaaucagucccuccagcaaagcaaagauuauaucaaggaagcgcagagacugcuggacaccgugaacccgucccuuauuucuaugcucagcaugaucauccuguacguccuguccauugccucucucugcaucggccugauuacauuuaucagcuucauuaucguggagaaaaagcggaacacguauucccgccuugaagauagacgggugcgcccuaccagcucuggggaccuguacuauaucggaacauga

SEQ ID NO: 967 - RNA, 1617 nt, Artificial Sequence
  derived and/or modified CDS sequence (opt5) from Nipah henipavirus__AAM13405__HsIgE(1-18)_F(27-546)
auggacuggaccuggauccuguuccucguggccgcugccacaagaguccacagcauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgaccgaggacuuugaugaccuccuggagagcgauucuauuacaggacagaucauuuacgucgaccuguccagcuauuacaucauugugcgcguuuauuucccuauccucaccgaaauccaacaggccuacauucaggagcugcuucccguguccuuuaacaaugacaacucugaauggaucagcauugucccuaauuucauccuggugagaaacacccucauuuccaauaucgagauuggcuuuugucugaucacaaagcggagcguuaucugcaaccaggauuaugcuacgccgaccacaaauaacaugcgcgaaugucuuaccgggucuacagagaaaugccccagagagcugguggucuccagccacgugccucgguucgcccucucuaauggaguccuguuugcuaacuguauuagcgugaccugccaaugucagacgacaggccgcgccaucucccagucuggcgaacaaacccugcucaugauugacaauaccacaugccccaccgccguucuggggaacgugaucauuagccuuggaaaguaccugggcuccgucaauuacaacagcgaggggaucgcuaucggaccucccguguucacagauaagguugacauuucuucccagaucagcucuaugaaucagucccuccagcaaagcaaagauuauauuaaggaagcgcagagacugcuggacacggugaacccgucccuuaucucuaugcucagcaugauuauccuguacguccuguccaucgccucucucugcauuggccugaucaccuuuauuagcuucaucauuguggagaaaaagcggaacacauauucccgccuugaagauagacgggugcgcccuaccagcucuggggaccuguacuauaucggaacauga

SEQ ID NO: 968 - RNA, 1617 nt, Artificial Sequence
  derived and/or modified CDS sequence (opt5) from Nipah henipavirus__CBM41033__HsIgE(1-18)_F(27-546)
auggacuggaccuggauccuguuccucguggccgcugccacaagaguccacagcauccuccacuaugaaaaacugagcaagauugggcuugugaaaggagugacccggaaguacaaaaucaaguccaauccccugacaaaggauaucgucauuaaaaugaucgccaacgugucuaauaugagccagugcacgggcuccguuauggagaacuauaagacccgccucaaugggauucugacaccuaucaaaggagcucuggaaauuuacaagaacaauacccaugaccucgugggcgaugucagacuggccggggugaucauggcgggaguugcuauuggcaucgccacagccgcucaaaucaccgccggcguggcucuuuaugaggccaugaaaaacgcggacaauauuaacaagcugaagucuagcaucgaauccacaaaugaggccgucgugaaacuccaggagaccgcugaaaagacgguguacguccugaccgcccuucaggauuauauuaacacaaaucugguuccgaccaucgacaaaauuagcuguaagcagacagagcucucucuggaucuggcucucuccaaauaccugagcgaccuucuguucguguuugggcccaaccuccaagauccugugucuaauuccaugaccauccaggccaucagccaggcguucggaggcaacuacgaaacgcugcuucggacacugggguaugccaccgaggacuuugaugaccuccuggagucugauuccauuacaggacagaucauuuacgucgaccugagcuccuauuacaucauugugcgcguuuauuuccccauccucaccgaaauccaacaggcuuacauucaggagcugcuuccugugucuuuuaacaaugacaacagcgaauggaucuccauuguccccaauuucauccuggugagaaacacccucauuagcaauaucgagauuggcuuuugccugaucacaaagcggucuguuaucuguaaccaggauuaugccacgccuaugaccaauaacaugcgcgaaugccuuacaggguccaccgagaaauguccgagagagcugguggucagcucucacgugccccgguucgcucucagcaauggaguccuguuugccaacugcauuuccgugacaugucaaugccagaccacgggccgcgccaucucucagagcggcgaacaaacacugcucaugauugacaauaccaccuguccuacagcuguucuggggaacgugaucauuucccuuggaaaguaccugggcagcgucaauuacaacucugaggggaucgcgaucggacccccuguguucaccgauaagguugacauuuccagccagaaaucuuccaugaaucagagccuccagcaauccaaggauuauaucaaagaagcccagagacugcuggacacagugaaccccucucuuauuagcaugcucuccaugaucauucuguacguccugucuaucgcuagccucugcaucggccugauuacguuuaucuccuucauuaucguggagaagaaacggaacaccuauagccgccuugaagauagacgggugcgcccgacaucuuccggggaccuguacuauauuggaaccuga

SEQ ID NO: 969 - RNA, 1617 nt, Artificial Sequence
  derived and/or modified CDS sequence (opt5) from Nipah henipavirus__AEZ01396__HsIgE(1-18)_F(27-546)
auggacuggaccuggauccuguuccucguggccgcugccacaagaguccacagcauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauaccugagcgaucuucuguucgucuuugggccuaaucuccaagaccccguuucuaacuccaugaccauccaggccauuagccaggcguucggaggcaacuaugaaacgcugcuucggacacugggguacgccaccgaggauuuugacgaucuccuggagucugacuccaucacaggacagauuaucuauguggaucugagcggcuacuauauuaucgugcgcgucuacuucccuauccucaccgaaauucaacaggcuuauauccaggagcugcuucccguguccuuuaauaacgacaauucugaauggauuagcaucguuccuaacuucauucuggugagaaauacccucaucuccaacauugagaucggguuuugucugaucacaaagcggagcgucauuugcaaucaggacuacgccacgccgaugaccaacaauaugcgcgaaugucuuacaggaucuaccgagaaaugccccagagagcuggugguuuccagccacgugccucgguucgcucucucuaacggcguccuguuugccaauuguaucagcgugacaugccaaugucagaccacgggccgcgccauuucccagucuggggaacaaacacugcucaugaucgauaacacaaccugccccaccgcuguccugggaaaugugauuaucagccuuggcaaguaccugggguccguuaacuauaauagcgagggaaucgcgauuggcccucccguguucaccgacaaggucgauaucucuucccagauuagcucuaugaaccagucccuccagcaaagcaaagacuacaucaaggaagcccagagacugcuggauacagugaacccgucccuuauuucuaugcucagcaugaucauccuguauguucuguccauugcuucucucuguaucgggcugauuacguuuaucagcuucauuaucguggagaaaaagcggaauaccuacucccgccuugaagacagacggguccgcccuacaagcucuggagaucuguauuacaucggcaccuga

SEQ ID NO: 970 - RNA, 1617 nt, Artificial Sequence
  derived and/or modified CDS sequence (opt5) from Hendra henipavirus__NP_047111__HsIgE(1-18)_F(27-546)
auggacuggaccuggauccuguuccucguggccgcugccacaagaguccacagcauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaaaaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucgccgggcaaauugucuauguggaucugucuuccuacuauaucauuguucggguguacuucccuauccuuaccgagauucagcaggcuuauguccaggaacugcuccccgugagcuuuaacaacgacaauuccgaguggaucucuaucguuccuaacuucgugcugauucgcaauacccuuaucagcaacauugaagucaaguacugccugaucacaaagaaguccgugauuuguaaucaagacuaugccacgccgaugaccgccagcgucagagagugccucacaggaucuaccgauaaguguccccgggagcuggugguuuccagccacgugccucgcuuugcucugucuggcggcguccucuucgcgaacugcaucagcgugacaugucagugccagaccacggggagagccauuucccaaucuggagaacagacacugcuuaugaucgacaauaccaccuguacaaccguugugcugggcaacaucauuaucagccucgggaaauaccugggauccauuaauuacaacagcgagucuaucgcugucgggcccccuguguauacagauaagguggacauuuccagccagaucucuuccaugaaucagagccugcaacaguccaaagauuacaucaaggaagcccagaaaauucuugacacgguuaaccccucucucaucagcaugcuguccaugauuauccuguauguccucucuauugccgcucugugcaucggccuuaucaccuuuauuagcuucgugaucguggagaagaagcggggaaauuacucccgccuggaugacagacagguccggccggugagcaacggcgaucucuauuacauuggcacauga

SEQ ID NO: 971 - RNA, 1617 nt, Artificial Sequence
  derived and/or modified CDS sequence (opt5) from Hendra henipavirus__AEB21233__HsIgE(1-18)_F(27-546)
auggacuggaccuggauccuguuccucguggccgcugccacaagaguccacagcauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucaccgggcaaauugucuauguggaucugucuuccuacuauaucauuguucggguguacuucccuauccuuaccgagauucagcaggccuauguccaggaacugcuccccgugagcuuuaacaacgacaauuccgaguggaucucuaucguuccuaacuucgugcugauucgcaauacacuuaucagcaacauugaagucaaguacugccugaucacgaaaaaguccgugauuuguaaucaagacuaugcuaccccgaugacagccagcgucagagagugccucaccggaucuacagauaaguguccccgggagcuggugguuuccagccacgugccucgcuuugcccugucuggcggcguccucuucgcuaacugcaucagcgugaccugucagugccagacgacagggagagcgauuucccaaucuggagaacagacccugcuuaugaucgacaauaccacauguaccacaguugugcugggcaacaucauuaucagccucgggaaauaccugggauccauuaauuacaacagcgagucuaucgccgucgggcccccuguguauacggauaagguggacauuuccagccagaucucuuccaugaaucagagccugcaacaguccaaagauuacaucaaggaagcucagaaaauucuugacaccguuaaccccucucucaucagcaugcuguccaugauuauccuguauguccucucuauugccgcccugugcaucggccuuaucacauuuauuagcuucgugaucguggagaagaagcggggaaauuacucccgccuggaugacagacagguccggccggugagcaacggcgaucucuauuacauuggcaccuga

SEQ ID NO: 972 - RNA, 1620 nt, Artificial Sequence
  derived and/or modified CDS sequence (opt5) from Hendra henipavirus__AEQ38114__HsIgE(1-18)_F(26-546)
auggacuggaccuggauccuguuccucguggccgcugccacaagaguccacagcggaauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucaccgggcaaauugucuauguggaucugucuuccuacuauaucauuguucggguguacuucccuauccuuaccgagauucagcaggccuauguccaggaacugcuccccgugagcuuuaacaacgacaauuccgaguggaucucuaucguuccuaacuucgugcugauucgcaauacacuuaucagcaacauugaagucaaguacugccugaucacgaaaaaguccgugauuuguaaucaagacuaugcuaccccgaugacagccagcgucagagagugccucaccggaucuacagauaaguguccccgggagcuggugguuuccagccacgugccucgcuuugcccugucuggcggcguccucuucgcuaacugcaucagcgugaccugucagugccagacgacagggagagcgauuucccaaucuggagaacagacccugcuuaugaucgacaauaccacauguaccacaguugugcugggcaacaucauuaucagccucgggaaauaccugggauccauuaauuacaacagcgagucuaucgccgucgggcccccuguguauacggauaagguggacauuuccagccagaucucuuccaugaaucagagccugcaacaguccaaagauuacaucaaggaagcucagaaaauucuugacaccguuaaccccucucucaucagcaugcuguccaugauuauccuguauguccucucuauugccgcccugugcaucggccuuaucacauuuauuagcuucaucauuguggagaagaagcggggaaauuacucccgccuggaugacagacaggugcggccggucagcaacggcgaucucuauuacaucggcaccuga

SEQ ID NO: 973 - RNA, 1617 nt, Artificial Sequence
  derived and/or modified CDS sequence (opt5) from Hendra henipavirus__AAB39505__HsIgE(1-18)_F(27-546)
auggacuggaccuggauccuguuccucguggccgcugccacaagaguccacagcauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugcucauuugcucuuguuucggcccuaaucugcaggaucccguguccaacagcaugacgauccaggcgaucucucaggccuuugggggaaauuacgagacacuucugagaacccucggcuacgcuacagaggacuucgaugaccugcuggaauccgauagcauuaccgggcaaaucguguaugucgaccucucuuccuacuauauuaucgugcggguuuacuuuccuauucugaccgagauccagcaggccuaugugcaggaacuucugcccgucagcuucaacaacgauaauuccgaguggaucucuauugugccuaacuuuguucucauccgcaauacacugauuagcaacaucgaagugaaguacugccuuauuacgaaaaaguccgucaucuguaaucaagacuaugcuaccccgaugacagccagcgugagagagugccugaccggaucuacagacaaguguccccgggagcucgucguguccagccacguuccucgcuucgcccugucuggcggcgugcuguuugcuaacugcauuagcgucaccugucagugccagacgacagggagagcgaucucccaaucucgggaacagacccuccugaugaucgauaauaccacaugcaccacagugguucuuggaaacauuaucauuagccugcccaaauaccucggcuccaucaagcugcaagugcugcgcgcccuucuccuggggcaucagagcauucagacgaaagucgacaucucuucccagaucagcucuaugaaucagucccugcagcaaagcaaggauuacauuaaagaggcucagaagauccucgacaccgugaacccuucccugauuucuaugcuuagcaugaucauucuguaugugcucuccaucgccgcccuguguaucggacugauuacauucaucucuuuuguuauugucgaaaagaaaagaggcaauuacagccggcuugaugaccgccaggugagacccguguccaacggggaucucuauuacaucggaaccuga

SEQ ID NO: 974 - RNA, 1653 nt, Artificial Sequence
  derived and/or modified CDS sequence (opt5) from Nipah henipavirus__AAK50554__HsIgE(1-18)_G(70-602)
auggacuggaccuggauccuguuccucguggccgcugccacaagaguccacagccagaauuacacacggagcaccgauaaccaagcggucauuaaggacgcucuccaggggauccagcagcaaauuaaaggacuggccgauaagaucggcacagaaaucgggccgaaagugucccuuauugacaccucuagcacaaucaccauucccgccaauaucggacugcucggcuccaagauuagccagucuacggcuuccaucaacgagaauguuaacgaaaagugcaaauucacccugccuccccugaagauccacgaguguaauauuagcugcccuaacccccucccuuuucgcgaguauagaccgcagacagaaggcgugucuaaucuggucgggcuucccaacaauaucugucugcagaaaaccuccaaccaaauucucaagccuaaacugaucagcuacacacuucccgugguuggacagucugggaccugcauuacggauccucugcucgccauggacgagggcuauuucgcuuacucccaucuggaacggaucggaagcuguucccgcggcgugucuaagcagagaaucauuggggucggagaggugcuggaucggggcgacgaggugcccagccucuuuaugacaaacgucuggaccccgccuaaucccaacacaguuuaucacugcuccgccguguacaauaacgaguucuacuaugugcugugugcggucagcaccgugggcgauccuauccuuaauucuaccuacugguccgggagccugaugaugacacgccucgccguuaaacccaagucuaacggaggcggguauaaucagcaucaacuggcucuuagaagcauugaaaagggacgguacgacaaagugaugcccuauggcccuuccgggaucaagcagggagauacgcuguacuuuccggccgucggcuuccucgugcgcaccgaauuuaaauauaacgacucuaauugccccauuacaaagugucaguacagcaaaccugagaacugcagacuguccaugggcauccggcccaauagccacuacauucugcgcucugggcuccugaaguauaaccuuuccgacggagaaaauccuaagguuguguucaucgagaucagcgaucaaagacugucuauuggcucccccagcaaaaucuacgacucccucgggcagccggucuuuuaucaggcuucuuucagcugggauaccaugauuaaguuuggagacgugcugacagucaacccucuugugguuaauuggcggaacaacaccgugaucucccgccccggccagucucaauguccuagauucaauacgugccccgagauuugcugggaaggggucuacaacgaugccuuccugaucgaccggaucaauuggauuagcgcgggcguguuucucgauuccaaccagacagccgagaauccuguuuucaccguguuuaaagacaacgaaauccuguauagagcucagcuggccagcgaggauaccaaugcucagaagacaauuaccaacuguuuccuccugaaaaauaagaucuggugcauuucucuugucgaaaucuacgacacaggagauaacgugauccgccccaagcuguuugccgugaaaauuccggagcaauguacguga

SEQ ID NO: 975 - RNA, 1653 nt, Artificial Sequence
  derived and/or modified CDS sequence (opt5) from Nipah henipavirus__AEZ01389__HsIgE(1-18)_G(70-602)
auggacuggaccuggauccuguuccucguggccgcugccacaagaguccacagccagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccauucuuaauucuaccuacuggagcggcucccugaugaugaccagacucgccguuaagccuaaaaacaauggggaaucuuauaaccagcaucaauuugcucugcggaauaucgaaaagggaaaauacgacaaggugaugcccuauggccccagcgggauuaaacagggagauacacuuuacuucccugccgucggcuuucuggugcgcacggaguucaaguauaacgacuccaauugcccgaucgcugaaugucaguacagcaagcccgagaacugcagacucucuauggggauucggccuaauucccacuacauccugcgcagcggacugcucaaauauaaccugucugacgaggaaaauuccaagauuguuuuuaucgagaucagcgaucaaagacuuuccauuggcucucccagcaaaaucuacgacucccugggccagccuguguucuaucaggccucuuuuagcugggauaccaugauuaaguucggggacguccagacagugaacccccucgucgugaacuggcgggauaauaccguuaucucccgcccgggacaaagccaguguccuagauucaacaaaugccccgaagugugcugggagggcgucuacaaugacgcguuucugauugaucggaucaacuggaucucugccgggguguuccuugacuccaaucagacagcugaaaacccuguuuuuaccguguucaaggauaaugagguccuguaucgcgcccagcucgcuagcgaggacacgaacgcccaaaagacaauuaccaauuguuuucugcugaaaaacaagaucuggugcauuucucucguggaaaucuacgauaccggagacaaugugauuagacccaaacuguucgccguuaagaucccugagcaguguacauga

SEQ ID NO: 976 - RNA, 1653 nt, Artificial Sequence
  derived and/or modified CDS sequence (opt5) from Nipah henipavirus__ACT32615__HsIgE(1-18)_G(70-602)
auggacuggaccuggauccuguuccucguggccgcugccacaagaguccacagccagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccguucuuaauucuaccuacuggagcggcucccugaugaugaccagacucgccgugaagccuaaaaacaauggggaaucuuauaaccagcaucaauuugcucugcggaauauugaaaagggaaaauacgacaaggucaugcccuauggccccagcgggaucaaacagggagauacacuuuacuucccugccgugggcuuucugguucgcacggaguucaaguauaacgacuccaauugcccgauugcugaaugucaguacagcaagcccgagaacugcagacucucuauggggauccggccuaauucccacuacauucugcgcagcggacugcucaaauauaaccugucugacgaggaaaauuccaagaucguguuuauugagaucagcgaucaaagacuuuccaucggcucucccagcaaaauuuacgacucccugggccagccugucuucuaucaggccucuuuuagcugggauaccaugaucaaguucggggacgugcagacagucaacccccucgugguuaacuggcgggauaauaccgugauuucccgcccgggacaaagccaguguccuagauucaacaaaugccccgaagucugcugggagggcguguacaaugacgcguuucugaucgaucggauuaacuggaucucugccgggguuuuccuugacuccaaucagacagcugaaaacccuguguuuaccgucuucaaggauaaugaggugcuguaucgcgcccagcucgcuagcgaggacacgaacgcccaaaagacaaucaccaauuguuuucugcugaaaaacaagauuuggugcaucucucucguggaaauuuacgauaccggagacaauguuaucagacccaaacuguucgccgucaagauuccugagcaguguacauga

SEQ ID NO: 977 - RNA, 1653 nt, Artificial Sequence
  derived and/or modified CDS sequence (opt5) from Nipah henipavirus__CAF25497__HsIgE(1-18)_G(70-602)
auggacuggaccuggauccuguuccucguggccgcugccacaagaguccacagccagaacuacacacggagcaccgauaaucaagcggucaucaaggacgcucuccaggggauucagcagcaaaucaaaggacuggccgauaagauuggcacagaaaucgggccgaaagugucccuuaucgacaccucuagcacaauuaccauccccgccaacauuggacugcucggcuccaagaucagccagucuacggcuuccauuaaugagaacguuaaugaaaagugcaaauucacccugccuccccugaagauccacgaguguaacaucagcugcccuaauccccucccuuuucgcgaguauagaccgcagacagaaggcgugucuaaccuggucgggcuucccaauaacauuugucugcagaaaaccuccaaccaaauccucaagccuaaacugauuagcuacacacuucccgugguuggacagucugggaccugcaucacggauccucugcucgccauggacgagggcuauuucgcuuacucccaucuggaacggauuggaagcuguucccgcggcgugucuaagcagagaaucaucggggucggagaggugcuggaucggggcgacgaggugcccagccucuuuaugacaaaugucugggccccgccuaaccccaauaccguuuaucacugcuccgcgguguacaacaaugaguucuacuaugugcugugugccgucagcacagugggcgauccuauucuuaacucuaccuacugguccgggagccugaugaugacccgccucgcuguuaaacccaagucuaauggaggcggguauaaccagcaucaacuggcccuuagaagcaucgaaaagggacgguacgacaaagugaugcccuauggcccuuccgggauuaagcagggagauacacuguacuuuccggcugucggcuuccucgugcgcacggaauuuaaauauaaugacucuaacugccccaucaccaagugucaguacagcaaaccugagaauugcagacuguccaugggcauucggcccaacagccacuacauccugcgcucugggcuccugaaguauaaucuuuccgacggagaaaacccuaagguuguguucauugagaucagcgaucaaagacugucuaucggcucccccagcaaaauuuacgacucccucgggcagccggucuuuuaucaggccucuuucagcugggauacaaugaucaaguuuggagacgugcugaccgucaauccucuugugguuaacuggcggaacaauacagugauuucccgccccggccagucucaauguccuagauucaauaccugccccgagaucugcugggaaggggucuacaacgaugcguuccugauugaccggaucaacuggaucagcgccggcguguuucucgauuccaaucagacggcugagaacccuguuuucacaguguuuaaagacaaugaaauucuguauagagcccagcuggcuagcgaggauaccaacgcccagaagaccaucacaaauuguuuccuccugaaaaacaagauuuggugcaucucucuugucgaaauuuacgacaccggagauaaugugauccgccccaagcuguuugccgugaaaaucccggagcaauguacauga

SEQ ID NO: 978 - RNA, 1653 nt, Artificial Sequence
  derived and/or modified CDS sequence (opt5) from Nipah henipavirus__CBM41034__HsIgE(1-18)_G(70-602)
auggacuggaccuggauccuguuccucguggccgcugccacaagaguccacagccagaacuacacacggagcaccgauaaucaagcggucaucaaggacgcucuccaggggauucagcagcaaaucaaaggacuggccgauaagauuggcacagaaaucgggccgaaagugucccuuaucgacaccucuagcacaauuaccauccccgccaacauuggacugcucggcuccaagaucagccagucuacggcuuccauuaaugagaacguuaaugaaaagugcaaauucacccugccuccccugaagauccacgaguguaacaucagcugcccuaauccccucccuuuucgcgaguauagaccgcagacagaaggcgugucuaaccuggucgggcuucccgauaauauuugucugcagaaaaccuccaaccaaauccucaagccuaaacugauuagcuacacacuucccgugguuggacagucugggaccugcaucacggacccucugcucgccauggaugagggcuauuucgcuuacucccaucuggaacggauuggaagcuguucccgcggcgugucuaagcagagaaucaucggggucggagaggugcuggaccggggcgaugaggugcccagccucuuuaugacaaacgucuggaccccgccuaaucccaacacaguuuaucacugcuccgccguguacaauaacgaguucuacuaugugcugugugcggucagcaccgugggcgacccuauucuuaauucuaccuacugguccgggagccugaugaugacacgccucgccguuaaacccaagucuaacggaggcggguauaaucagcaucaacuggcucuuagaagcaucgaaaagggacgguacgauaaagugaugcccuauggcccuuccgggauuaagcagggagacacgcuguacuuuccggccgucggcuuccucgugcgcaccgaauuuaaauauaacgacucuaauugccccaucacaaagugucaguacagcaaaccugagaacugcagacuguccaugggcauucggcccaauagccacuacauccugcgcucugggcuccugaaguauaaccuuuccgauggagaaaauccuaagauuguuuucaucgagaucagcgaccaaagacugucuauuggcucccccagcaaaguguacgauucccucgggcagccggucuuuuaucaggcuucuuucagcugggacaccaugaucaaguuuggagaugugcagacagucaacccucuggugguuaauuggcgggacaacaccgugauuucccgccccggccaaucucaguguccuagauucaacacgugccccgagaucugcugggaaggggucuacaaugaugccuuccuuauugaccggaucaacuggaucagcgcgggcguguuucuggauuccaaucagacagccgagaacccuguuuucaccguguuuaaagacaaugaaauucucuauagagcucagcuggccagcgaggauaccaacgcucaaaagacaaucaccaauuguuuccugcucaaaaacaagauuuggugcaucucucuggucgaaauuuacgacacaggagacaaugugauccgccccaaacuuuuugccgugaagaucccggagcaguguacguga

SEQ ID NO: 979 - RNA, 1653 nt, Artificial Sequence
  derived and/or modified CDS sequence (opt5) from Nipah henipavirus__AAX51853__HsIgE(1-18)_G(70-602)
auggacuggaccuggauccuguuccucguggccgcugccacaagaguccacagccagaacuacacacgguccaccgauaaucaagcggugaucaaggacgcucuccaggggauucagcagcaaaucaaaggacuggccgauaagaucggcacagaaauugggccgaaagucucucuuaucgacaccagcuccacaauuaccauccccgccaacauuggacugcucggcagcaagaucucucaguccacggcuagcaucaaugagaacgugaaugaaaagugcaaauucacccugccuccccugaagauucacgaguguaacaucucuugcccuaauccccucccuuuucgcgaguauagaccgcagacagaaggcguuuccaaccugguggggcuucccaauaacauuugucugcagaaaaccagcaaucaaauccucaagccuaaacugauuucuuacacacuucccgucgugggacaguccgggaccugcaucacggauccucugcucgccauggacgagggcuauuucgcuuacagccaucuggaacggaucggauccuguucucgcggcguuagcaagcagaaaauuaucggggugggagagguccuggauagaggcgacgaggugcccucccucuuuaugacaaacguguggaccccgccuaaccccaauacagucuaucacugcagcgccguuuacaacaaugaguucuacuaugugcugugugcggugucuaccgucggcgauccuauucuuaacuccaccuacuggagcgggucucugaugaugacacggcucgccgugaagcccaagagcaaugacggaggcuauaaccagcaucaacuggcccuucgcuccaucgaaaaagggagauacgauaagguuaugcccuauggaccuucuggcauuaaacagggggacacgcuguacuuuccggcugugggauuccucguccggaccgaauuuaaguauaaugacagcaacugccccaucacaaaaugucaguacuccaagccugagaauugccgccugagcaugggcauuagacccaacucucacuacgugcugcgguccggccuccugaaguauaaucuuagcgauggggaaaacccuaaaaucguuuucaucgagauuucugaccaacgccuguccaucggaagccccuccaagauuuacgauucucucggccagccgguguuuuaucaggcuagcuucuccugggacaccaugaucaaauuuggggauguccagacagugaauccucuggucgugucuuggagagacaacaccguuauuagccggcccggacaaucccaguguccucgcuucaauacgugccccgagaucugcugggaaggcguguacaacgaugccuuccuuaucgacagaauuaacuggaucagcgcgggggucuuucuggauucuaaucagacagccgagaacccuguguucaccguuuuuaaggacaaugaaauucucuaucgggcucagcuggccuccgaggauaccaacgcucagaaaacaaucaccaauuguuuccugcucaagaacaagauuuggugcaucagccugguggaaaucuacgacacaggcgacaaugucauuagacccaaacuuuuugccgugaagaucccggagcaauguacguga

SEQ ID NO: 980 - RNA, 1653 nt, Artificial Sequence
  derived and/or modified CDS sequence (opt5) from Nipah henipavirus__AEZ01397__HsIgE(1-18)_G(70-602)
auggacuggaccuggauccuguuccucguggccgcugccacaagaguccacagccagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccauucuuaauucuaccuacuggagcggcucccugaugaugaccagacucgccguuaagccuaaaaacaauggggaaucuuauaaccagcaucaauuugcucugcggaauaucgaaaagggaaaauacgacaaggugaugcccuauggccccagcgggauuaaacagggagauacacuuuacuucccugccgucggcuuucuggugcgcacggaguucaccuauaacgacuccaauugcccgaucgcugaaugucaguacagcaagcccgagaacugcagacucucuauggggauucggccuaauucccacuacauccugcgcagcggacugcucaaguauaaccugucugacgaggaaaauuccaaaauuguuuuuaucgagaucagcgaucaaagacuuuccauuggcucucccagcaagaucuacgacucccugggccagccuguguucuaucaggccucuuuuagcugggauacaaugauuaaauucggggacguccagaccgugaacccccucgucgugaacuggcgggauaauacaguuaucucccgcccgggacaaagccaguguccuagauucaacaagugccccgaagugugcugggagggcgucuacaaugacgcguuucugauugaucggaucaacuggaucucugccgggguguuccuugacuccaaucagaccgcugaaaacccuguuuuuacgguguucaaagauaaugagguccuguaucgcgcccagcucgcuagcgaggacacaaacgcccaaaagaccauuaccaauuguuuucugcugaagaacaaaaucuggugcauuucucucguggaaaucuacgauacaggagacaaugugauuagacccaagcuguucgccguuaaaaucccugagcaguguaccuga

SEQ ID NO: 981 - RNA, 1659 nt, Artificial Sequence
  derived and/or modified CDS sequence (opt5) from Hendra henipavirus__NP_047112__HsIgE(1-18)_G(70-604)
auggacuggaccuggauccuguuccucguggccgcugccacaagaguccacagccaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucgcgaucaccaagguggaacgggggaaauacgauaaggugaugccuuauggacccagcggcauuaaacaaggggacacacuguacuuucccgccgucggauuccugccucgcaccgaguuucaguauaaugauuccaacugcccgaucauucacuguaaguacagcaaagcugagaauugcagacucucuaugggcgugaacuccaagagccacuauauccugcggucugggcuucugaaguacaaucucucccugggaggcgacauuauccuucaguucaucgaaauugccgauaaccgccugacgaucggcagccccuccaaaauuuacaauucucucgggcaaccuguguuuuaucaggcuagcuacuccugggacacaaugaucaagcugggagauguugacaccgucgauccccugagagugcaguggcggaacaauucuguuauuagccgcccuggccagucccaaugucccagauucaacgugugcccggaggucugcugggaagggaccuauaaugacgccuuucucaucgaccggcugaacugggugagcgcgggagucuaccuuaacucuaaucagacagccgagaacccuguguucgcuguuuucaaagauaaugaaauccuguaucaggugccccucgccgaggacgauaccaacgcucagaagacaauuacggacuguuuucugcuggagaaugucaucuggugcauuucccuuguggaaaucuacgauaccggcgacagcguuauuagaccuaaacucuucgccgugaagauccccgcccaauguucugaguccuga

SEQ ID NO: 982 - RNA, 1659 nt, Artificial Sequence
  derived and/or modified CDS sequence (opt5) from Hendra henipavirus__AEB21225__HsIgE(1-18)_G(70-604)
auggacuggaccuggauccuguuccucguggccgcugccacaagaguccacagccaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucgcgaucaccaagguggaacgggggaaauacgauaaggugaugccuuauggacccagcggcauuaaacaaggggacacacuguacuuucccgccgucggauuccugccucgcaccgaguuucaguauaaugauuccaacugcccgaucauucacuguaaguacagcaaagcugagaauugcagacucucuaugggcgugaacuccaagagccacuauauccugcggucugggcuucugaaguacaaucucucccugggaggcgacauuacgcuucaguucaucgaaaucgccgauaaccgccugacaauuggcagccccuccaaaaucuacaauucucucgggcaaccuguguuuuaucaggcuagcuacuccugggacaccaugauuaagcugggagauguugacaccgucgauccccugagagugcaguggcggaacaauucuguuaucagccgcccuggccagucccaaugucccagauucaacgugugcccggaggucugcugggaagggacauauaaugacgccuuucucauugaccggcugaacugggugagcgcgggagucuaccuuaacucuaaucagaccgccgagaacccuguguucgcuguuuucaaagauaaugaaauccuguaucaggugccccucgccgaggacgauacaaacgcucagaagacgaucaccgacuguuuucugcuggagaaugucauuuggugcaucucccuuguggaaauuuacgauacaggcgacagcguuaucagaccuaaacucuucgccgugaagauucccgcccaauguucugaguccuga

SEQ ID NO: 983 - RNA, 1659 nt, Artificial Sequence
  derived and/or modified CDS sequence (opt5) from Hendra henipavirus__AEB21216__HsIgE(1-18)_G(70-604)
auggacuggaccuggauccuguuccucguggccgcugccacaagaguccacagccaaaauuacacgagaaccacagauaaccaggcgcuuaucaaagagucucugcagagcgugcagcaacagauuaaggcucucaccgacaaaaucggcacagaaaucgggccuaaggucucccugauugauaccucuagcacaaucaccauuccggccaauaucggacugcucggcuccaaaauuagccagucuacguccagcaucaacgagaaugugaacgacaagugcaaguuuacccugcccccucuuaaaauccacgaauguaauauuucuugccccaacccucugcccuuccgggaguaucgcccuaucucccagggcguuagcgaucucguggggcugccgaaucaaauuugucuucagaagacaaccucuacaauccugaaacccagacucauuuccuacacccugccuaucaacacgcgggaaggagucugcaucacagacccccugcucgccguggauaacggcuuuuucgcuuauagccaucuggagaagauuggguccuguacccgcggaaucgccaaacagagaauuaucggcguuggggaggugcuugaccggggagauaaggucccuucuauguuuaugacaaauguguggacacccccgaacccuagcaccauucaccauugcuccagcaccuaccacgaagacuucuauuacacgcugugugcugugucucaugucggcgaccccauccucaauuccaccagcuggacagagucucugagccuuauucgccuggccguuagaccuaaauccgauucuggcgacuacaaccagaaguauaucgcgaucaauaagguggaacgggggaaauacgauaaggugaugcccuauggacccagcggcauuaaacaaggggacacccucuacuuuccugccgucggauuccugccgcgcacagaguuucaguauaacgauuccaauugccccaucauucacuguaaguacagcaaagcugagaacugcagacugucuaugggcguuaauuccaagagccacuauauccuccggucugggcugcuuaaguacaaccugucccucggaggcgacauuauccugcaguucaucgaaauugccgauaaucgccuuaccaucggcagcccuuccaaaauuuacaacucucuggggcaacccguguuuuaucaggcuagcuacuccugggacacgaugaucaagcucggagauguggacacagucgauccucugagagugcaguggcggaauaacucuguuauuagccgccccggccagucccaauguccgagauucaaugugugcccugaggucugcugggaagggaccuauaacgacgccuuucugaucgaccggcucaacugggugagcgcgggagucuaccuuaauucuaaccagaccgccgagaaucccguguucgcuguuuucaaagauaacgaaauccuguaucaggugccucuggccgaggacgauacaaaugcucagaagaccauuacagacuguuuucuccuggagaacgucaucuggugcauuucccugguggaaaucuacgauacgggcgacagcguuauuagacccaaacuuuucgccgugaagaucccugcccaauguucugaguccuga

SEQ ID NO: 984 - RNA, 1659 nt, Artificial Sequence
  derived and/or modified CDS sequence (opt5) from Hendra henipavirus__AEB21206__HsIgE(1-18)_G(70-604)
auggacuggaccuggauccuguuccucguggccgcugccacaagaguccacagccaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcaacuacaaucagaaguauaucgcgaucaccaagguggaacgggggaaauacgacaaggugaugccuuauggacccagcggcauuaaacaaggggauacacuguacuuucccgccgucggauuccugccucgcaccgaguuucaguauaacgacuccaauugcccgaucauucacuguaaguacagcaaagcugagaacugcagacucucuaugggcguuaauuccaagagccacuauauccugcggucugggcuucugaaguacaaccucucccugggaggcgauauuauccuucaguucaucgaaauugccgacaaucgccugacgaucggcagccccuccaaaauuuacaacucucucgggcaaccuguguuuuaucaggcuagcuacuccugggauacaaugaucaagcugggagacauugauaccguggacccccugagaguccaguggcggaauaacucugugaucagccgcccuggccagucccaaugucccagauucaauguuugcccggaggugugcugggaagggaccuauaacgaugccuuucucaucgaccggcugaacugggucagcgcgggaguguaccuuaauucuaaccagacagccgagaauccugucuucgcuguguucaaagacaacgaaauucuguaucagguuccccucgccgaggaugacaccaaugcucagaagacaaucacggauuguuuucugcuggagaacgugauuuggugcaucucccuugucgaaauuuacgacaccggcgauagcgugaucagaccuaaacucuucgccguuaagauccccgcccaauguucugaguccuga

SEQ ID NO: 985 - RNA, 1659 nt, Artificial Sequence
  derived and/or modified CDS sequence (opt5) from Hendra henipavirus__AEQ38052__HsIgE(1-18)_G(70-604)
auggacuggaccuggauccuguuccucguggccgcugccacaagaguccacagccaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucaccaucacaaagguggaacgggggaaauacgauaaggugaugccuuauggacccagcggcauuaaacaaggggacacccuguacuuucccgcggucggauuccugccucgcacggaguuucaguauaaugauuccaacugcccgaucauucacuguaaguacagcaaagccgagaauugcagacucucuaugggcgugaacuccaagagccacuauauccugcggucugggcuucugaaguacaaucucucccugggaggcgacauuauccuucaguucaucgaaauugcugauaaccgccugacaaucggcagccccuccaaaauuuacaauucucucgggcaaccuguguuuuaucaggccagcuacuccugggacaccaugaucaagcugggagauguugacaccgucgauccccugagagugcaguggcggaacaauucuguuauuagccgcccuggccagucccaaugucccagauucaacgugugcccggaggucugcugggaagggacauauaaugacgcuuuucucaucgaccggcugaacugggugagcgccggagucuaccuuaacucuaaucagaccgcggagaacccuguguucgccguuuucaaagauaaugaaauccuguaucaggugccccucgcugaggacgauacaaacgcccagaagacgauuaccgacuguuuucugcuggagaaugucaucuggugcauuucccuuguggaaaucuacgauacaggcgacagcguuauuagaccuaaacucuucgcugugaagauccccgcccaauguucugaguccuga

SEQ ID NO: 986 - RNA, 1659 nt, Artificial Sequence
  derived and/or modified CDS sequence (opt5) from Hendra henipavirus__AEQ38115__HsIgE(1-18)_G(70-604)
auggacuggaccuggauccuguuccucguggccgcugccacaagaguccacagccaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauaacggcgacuacaaucagaaguauaucgcgaucaccaagguggaacgggggaaauacgauaaggugaugccuuauggacccucuggcauuaaacaaggggacacacuguacuuucccgccgucggauuccugccucgcaccgaguuucaguauaacgauagcaauugcccgaucauucacuguaaguacuccaaagcugagaacugcagacucagcaugggcguuaauucuaagucccacuauauccugcggagcgggcuucugaaguacaaccucucucugggaggcgacauuauccuucaguucaucgaaauugccgauaaucgccugacgaucggcucccccagcaaaauuuacaacucccucgggcaaccuguguuuuaucaggcuucuuacagcugggacacaaugaucaagcugggagauguggacaccgucgauccccugagagugcaguggcggaauaacuccguuauuucucgcccuggccagagccaaugucccagauucaaugugugcccggaggucugcugggaagggaccuauaacgacgccuuucucaucgaccggcugaacuggguguccgcgggagucuaccuuaauagcaaccagacagccgagaauccuguguucgcuguuuucaaagauaacgaaauccuguaucaggugccccucgccgaggacgauaccaaugcucagaagacaauuacggacuguuuucugcuggagaacgucaucuggugcauuucucuuguggaaaucuacgauaccggcgacuccguuauuagaccuaaacucuucgccgugaagauccccgcccaauguagcgagucuuga

SEQ ID NO: 987 - RNA, 1659 nt, Artificial Sequence
  derived and/or modified CDS sequence (opt5) from Hendra henipavirus__AEQ38108__HsIgE(1-18)_G(70-604)
auggacuggaccuggauccuguuccucguggccgcugccacaagaguccacagccaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucaccaucacaaagguggaacgggggaaauacgauaaggugaugccuuauggacccagcggcauuaaacaagggaauacccuguacuuucccgcggucggauuccugccucgcacggaguuucaguauaacgacuccaauugcccgaucauucacuguaaguacagcaaagccgagaacugcagacucucuaugggcguuaauuccaagagccacuauauccugcggucugggcuucugaaguacaaccucucccugggaggcgauauuauccuucaguucaucgaaauugcugacaaucgccugacaaucggcagccccuccaaaauuuacaacucucucgggcaaccuguguuuuaucaggccagcuacuccugggauaccaugaucaagcugggagacguggauaccgucgacccccugagagugcaguggcggaauaacucuguuauuagccgcccuggccagucccaaugucccagauucaaugugugcccggaggucugcugggaagggacauauaacgaugcuuuucucaucgaccggcugaacugggugagcgccggagucuaccuuaauucuaaccagaccgcggagaauccuguguucgccguuuucaaagacaacgaaauccuguaucaggugccccucgcugaggaugacacaaaugcccagaagacgauuaccgauuguuuucugcuggagaacgucaucuggugcauuucccuuguggaaaucuacgacacaggcgauagcguuauuagaccuaaacucuucgcugugaagauccccgcccaauguucugaguccuga

SEQ ID NO: 988 - RNA, 1659 nt, Artificial Sequence
  derived and/or modified CDS sequence (opt5) from Hendra henipavirus__AAV80426__HsIgE(1-18)_G(70-604)
auggacuggaccuggauccuguuccucguggccgcugccacaagaguccacagccaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagugcacgucuuccaucaacgagaaugugaacgacaaguguaaguuuacccuuccgccccugaaaauccacgaaugcaauauuagcuguccuaacccccucccuuuccgggaguaucgccccaucucucagggcguuuccgaucugguggggcuuccuaaucaaauuugccugcagaagacaaccagcacaauccucaaaccgagacugauuucuuacacccugcccaucaacacgcgggaaggagucuguaucacagacccucuccuggccguggauaacggcuuuuucgcuuauucccaucuugagaagauugggagcugcacccgcggaaucgccaaacagagaauuaucggcguuggggaggugcuggaccggggagauaagguccccuccauguuuaugacaaauguguggaccccucccaacccgucuaccauucaccauuguagcuccacauaccacgaagacuucuauuacacgcucugcgcugugagccaugucggcgacccuauccuuaauucuaccuccuggacagagagccugucucugauucgccucgccguuagacccaaaagcgauuccggcgacuacaaccagaaguauaucgcgaucaccaagguggaacgggggaaauacgauaaggugaugccuuauggacccucuggcauuaaacaaggggacacacuguacuuucccgccgucggauuccugccucgcaccgaguuucaguauaaugauagcaacuguccgaucauucacugcaaguacuccaaagcugagaauuguagacucagcaugggcgugaacucuaagucccacuauauccugcggagcgggcuucugaaguacaaucucucucugggaggcgacauuauccuucaguucaucgaaauugccgauaaccgccugacgaucggcucccccagcaaaauuuacaauucccucgggcaaccuguguuuuaucaggcuucuuacagcugggacacaaugaucaagcugggagauguugacaccgucgauccccugagagugcaguggcggaacaauuccguuauuucucgcccuggccagagccaaugccccagauucaacgugugcccggaggucuguugggaaggguccuauaaugacgccuuucucaucgaccggcugaacugggugagcgcgggagucuaccuuaacucuaaucagaccgccgagaacccuguguucgcuguuuucaaagauaaugaaauccuguaucaggugccccucgccgaggacgauacaaacgcucagaagaccauuacagacugcuuucugcuggagaaugucaucugguguauuucccuuguggaaaucuacgauacgggcgacagcguuauuagaccuaaacucuucgccgugaagauccccgcccaaugcucugaguccuga

SEQ ID NO: 989 - RNA, 1617 nt, Artificial Sequence
  derived and/or modified CDS sequence (opt6) from Nipah henipavirus__AAK50553__HsIgE(1-18)_F(27-546)
auggacuggacauggauauuauuuuuaguagcagcagcaacaagaguacauucaauauuacauuacgaaaaacucucaaaaauaggauuagucaaaggaguaaccagaaaauauaaaaucaaauccaacccuuuaacaaaagacauagucauaaaaaugauccccaacguuagcaauaugucacaaugcacaggaucaguaauggaaaauuacaaaacaagacuaaacggcauucuaacucccaucaaaggagcacuugaaauauauaaaaacaauacucacgaccuuguaggagacguacgacuagccggaguaauuauggccggaguagcaauagguauagcgacagccgcgcaaauaacagcaggcgucgcacucuacgaagccaugaaaaacgcagauaauauaaacaaauuaaaaucauccauugaaagcaccaacgaagcaguaguaaaacuacaagaaaccgcagaaaaaacugucuauguacuaacagcauuacaagacuauaucaauacaaaccuagucccuacaaucgauaaaauaaguugcaaacaaaccgaacuaucauuagacuuagcauuaucaaaauaccuauccgacuuacuauucguauuuggccccaauuuacaagaccccguaucuaauaguaugacaauccaagccauaucucaagcauuuggaggaaacuaugaaacacuauuaagaacacuaggauacgcaacagaagacuucgacgaccuauuagaaucagauuccauaacaggacaaauaauauacguagaccuaucaucguauuacauaauaguaagaguauacuucccaauauuaacagaaauacaacaagcauacauacaagaauuacuacccguaucauucaauaaugacaacucagaauggauaagcauaguaccaaauuucauccucgucagaaacacauugauaaguaauauagaaaucgguuucugccuaaucacaaagagaucaguaauaugcaaccaagacuacgcaacaccaaugacaaacaauaugcgcgaaugcuuaacaggcucaacagaaaaaugcccaagagaacuagucguuucaucacacguaccacgauuugcccuauccaacggaguacuauuugccaacugcaucucaguaacaugccaaugucaaacuacaggacgagcuauuucccaauccggagaacaaacacuccucaugauagacaauacaacuuguccaacagcuguacuuggaaacguaauaauuucccucggcaaauaccuaggaucaguaaauuauaauucagaaggaauagccauaggacccccaguguucaccgacaaaguagacaucucaucccaaauuucaucaaugaaccaaucucuccaacaaucaaaagauuacaucaaagaagcacaaagacuauuagauaccguaaaccccucauuaauaucaaugcuaucaaugaucaucuuauacgucuuaucaauagcaucacuaugcauaggacucaucaccuuuauauccuuuaucauaguagaaaaaaaaagaaacaccuacuccagauuagaagauagacgaguaagaccuacaucaucaggagacuuauacuacaucggcacauaa

SEQ ID NO: 990 - RNA, 1617 nt, Artificial Sequence
  derived and/or modified CDS sequence (opt6) from Nipah henipavirus__AEZ01388__HsIgE(1-18)_F(27-546)
auggacuggacauggauauuauuuuuaguagcagcagcaacaagaguacauucaauacuacauuacgaaaaacuaucaaaaauaggucucgucaaagggauuacaagaaaauacaaaauaaaaucaaacccccuaacaaaagacauagucauaaaaaugauaccaaacguaucaaauaugucacaauguacaggaagcguaauggaaaacuacaaaacacgacuuaacggaaucuuaacaccuauaaaaggagcuuuagaaauauacaaaaauaacacacacgaucuaguaggagauguucgacucgcaggagucauaauggcaggcguagccauagguauagcaaccgccgcacaaauuaccgcaggaguagccuuauacgaagcaaugaaaaacgccgauaacauaaacaaacuaaaaucauccaucgaaucaaccaacgaagcagucguaaaacuacaagaaaccgccgaaaaaacagucuauguccuaacagcauuacaagacuacauaaauaccaaucuuguuccaacaauagauaaaauuucaugcaaacaaacagaacuaucucucgaccuagcauuaucaaaauacuuauccgaccuacuauucguauuuggacccaaccuacaagaucccgucucuaacucuaugacaauccaagcaaucucacaagccuucggaggaaauuacgaaacauuacuaagaacacucggauaugcaacagaagacuucgacgaucuacuagaaagcgauuccauaaccggacaaauaauauacgucgaucuauccggauauuacaucauaguuagaguauauuucccaauauuaacagaaauacaacaagcauacauacaagaacuacuccccgucucuuuuaacaacgauaacuccgaauggauaucaauugucccaaacuucauacuaguccgcaauacacuaauuuccaauauagaaauagguuucugucucaucacaaaaagaucagucauaugcaaccaagacuaugcaacacccaugacaaauaacaugagagaaugccuaaccggcucaaccgaaaaaugcccacgagaacuaguuguaucuucacaugucccccgcuucgcacucucuaacggaguauuauucgcaaacugcauaucaguaacuugccaaugucaaacaacaggcagagccauaucacaaucuggagaacaaacacuauuaaugaucgacaauacaacauguccaacagcaguccuaggaaacguaauaauaucacuaggcaaauaccuaggaucaguaaacuacaacuccgaaggaaucgcaauaggaccccccgucuuuacagacaaagucgacauauccucacaaauauccucaaugaaucaaucucuacaacaauccaaagacuacauuaaagaagcacaaagacuauuagauacaguuaacccaucccucauauccauguuaucaaugauaauacuauauguccuaucaaucgcaucccucuguaucggauuaaucacauucauaucauuuauuauaguagaaaaaaaacgaaacaccuacuccagacuugaagaucgacgaguaagaccaaccucaucaggcgauuuauauuacauuggaacauaa

SEQ ID NO: 991 - RNA, 1617 nt, Artificial Sequence
  derived and/or modified CDS sequence (opt6) from Nipah henipavirus__AAY43915__HsIgE(1-18)_F(27-546)
auggacuggacauggauauuauuuuuaguagcagcagcaacaagaguacauucaauacuccacuaugaaaaauuaucaaaaauaggauuagucaaaggaauaacaagaaaauauaaaaucaaaucaaauccccuaacaaaagauaucguaauuaaaaugauaccaaauguaucaaauaugagucaaugcaccggaagcguaauggaaaauuauaaaacacgcuuaaacggaauacuaaccccaaucaaaggagcuuuagaaauuuauaaaaacaacacacaugauuuaguaggcgauguaagacuagcaggcguaauuauggcuggcguugcaauaggaauagcuacagcugcccaaauaaccgcuggagucgcacucuaugaagcaaugaaaaacgcugacaacauaaauaaacuaaaaucaucaauagaaagcaccaaugaagccgucguaaaacuacaagaaacagcagaaaaaacaguauacguauuaaccgcuuuacaagacuauauaaauacuaacuuaguccccacaauugacaaaauuuccugcaaacagacagaacuaucacucgauuuagcauuaucaaaauacucuuccgacuuacuauucguauucgguccuaaucuacaagacccagucuccaacuccaugacuauccaagcaauaucccaagcauuuggaggaaauuaugaaacacucuuaagaacccucggauacgcaacagaaggcuucgaugaccuacucgaauccgacaguaucacaggacaaauaauauauguagacuuaucuggauacuauauaauaguaagaguauacuuuccaauucuaacagaaauacaacaagccuacauccaagaacuauuaccuguuucauuuaacaaugacaacuccgaauggauaucaauaguacccaauuucauccuuguuaggaacacccuaauauccaacauugaaaucggauuuuguuuaauaaccaaacgaucagucaucugcaaccaagauuaugcaacaccaaugaccaacaacaugagagaaugccuaacaggaucaacagaaaaauguccacgagaacuaguagucucaucccauguaccaagauucgccuuaucuaacgguguacuauucgcaaacugcaucaguguuaccugccaaugucaaaccacaggcagagccauaucucaaucuggagaacaaacacuacucaugauagacaauacaacuuguccaaccgcaguauuaggcaacguuauaauaucauuaggaaaauaccuaggaagugucaacuauaacucagaaggaauugcuauaggaccacccguauucacagauaaaguagacauauccucacaaauaucauccaugaaccaaucauuacaacaaucuaaagauuacauaaaagaagcacaaagacuauuagacacaguaaauccaucauuaauaucuaugcuaucaaugauaauacuauauguccucucaauugcuucacuuugcauaggccuaauaaccuuuaucucauucauaauaguagaaaaaaaacgaaacacauacuccagacuagaagacagacgaguuagacccacauccucaggugaccuauauuacauaggaacauaa

SEQ ID NO: 992 - RNA, 1617 nt, Artificial Sequence
  derived and/or modified CDS sequence (opt6) from Nipah henipavirus__CAF25496__HsIgE(1-18)_F(27-546)
auggacuggacauggauauuauuuuuaguagcagcagcaacaagaguacauucaaucuuacauuaugaaaaacuaucaaaaauuggauuaguaaaagguguaacacgaaaauacaaaaucaaaucaaacccucuaacaaaagauauagucauaaaaaugauccccaacguaucaaacaugucacaauguaccggaucaguaauggaaaacuauaaaacgagauuaaacggaauucuaaccccaauaaaaggugcucuugaaauauauaaaaacaacacacacgaccuagucggagacguaagacuagcuggcguaauaauggccgguguagcaauaggaauagcaacagccgcacaaauaacagcuggcgucgcccuauacgaagcaaugaaaaaugcagacaacauuaacaaacuaaaaucaucaauagaauccacaaacgaagccguaguaaaauuacaagaaaccgcagaaaaaacaguauauguauuaaccgcacuucaagacuacauaaacaccaaucucguaccaacaauagacaaaauaucuuguaaacaaacagaacuaucacuagaucuagcauuaagcaaauacuuaucagacuuacucuucguauuuggaccaaaccuacaagaccccguaucaaacucaaugacaauacaagccauaucacaagcauuuggaggaaacuacgaaacacuauuaagaacacucggcuaugccauagaagacuucgacgaucuauuagaaucagauucaauaacaggccaaauaauauauguagaccucaguucauauuacaucauaguccgaguuuacuucccaauccuaacagaaauacaacaagcauacauacaagaacuacuaccaguauccuucaacaacgacaacucugaauggauaucaauagucccuaauuuuauacuaguaagaaacacauuaauaagcaacauagaaauaggauucugccuaauaacaaaaagauccguuauauguaaccaagacuacgcaacccccaugacaaacaacaugagagaaugucuaacaggcucaaccgaaaaauguccuagagaauuagucguaucaucacauguaccaagauucgcacuaucaaauggaguacucuucgcaaauuguaucucaguuaccugccaaugccaaaccaccggaagagcaauaucacaaucuggagaacaaacauuacuaaugaucgauaacacuacuugucccacagcaguucuuggaaacgucaucauaucacuaggaaaauaccuaggcucaguaaacuacaauagcgaagguauagccauuggaccaccaguuuuuacugacaaaguagacaucucaagucaaauaucaucaaugaaccaaagcuuacaacaaucuaaagauuauauaaaagaagcacaaaggcuacuagacaccgucaacccaucauuaauaagcaugcuaucaaugauaauuuuauauguauuauccaucgcuucucuaugcauaggccuaauaaccuucauaagcuucauuauuguugaaaaaaaaagaaauacauacucacgacuagaagacagaagaguccgaccaacauccucaggagauuuauauuauauaggaaccuaa

SEQ ID NO: 993 - RNA, 1617 nt, Artificial Sequence
  derived and/or modified CDS sequence (opt6) from Nipah henipavirus__AAM13405__HsIgE(1-18)_F(27-546)
auggacuggacauggauauuauuuuuaguagcagcagcaacaagaguacauucaauacuccauuacgaaaaacuaucaaaaauaggcuuaguuaaaggaguaacaagaaaauacaaaauaaaaucaaauccacuaacuaaagauauaguaaucaaaaugauacccaacguaucaaauaugucacaauguacuggaucaguuauggaaaauuacaaaacaagauuaaacggaauucucacacccauaaaaggagcacuagaaauuuacaaaaauaacacucacgaccuagucggcgacguaagauuagcagguguaaucauggcagguguagccaucggcauagcaacagcagcccaaauaaccgccggcguugcuuuauaugaagcaaugaaaaacgcagauaauauaaacaaauuaaaaucaucaauagaaucaacaaacgaagcuguaguaaaacuucaagaaacagcagaaaaaacaguauacguacuaacagcuuuacaagacuacaucaacacaaaccuaguaccaacgauagacaaaauaucaugcaaacaaacagaacuaucuuuagaucuagcauuaucaaaauaucuaagcgaccuucucuucguguucggucccaaccuacaagacccagucucaaacucuaugacaauacaagcaauaucacaagcauucggaggcaacuaugaaacacuacucagaacacucggcuaugccacagaagacuucgacgauuuacuagaaucagacuccauaaccggacaaauuaucuacguagaccucucgucuuacuacauaauaguaagagucuauuuccccauauuaacagaaauccaacaagcauacauacaagaacuucuaccaguaucauucaauaacgacaacucagaauggauaucaauagucccaaauuucauacuaguacguaauaccuuaaucucaaauauagaaauaggauucuguuuaaucacaaaaagaucaguaauaugcaaccaagacuacgccacaccaacgacaaacaacaugcgcgaaugucucacuggaucuacagaaaaaugccccagagaacuaguaguaucuucccacguaccacgauucgcacuguccaauggaguauuauucgcaaacugcauaagcguaacuugccaaugccaaacuaccggccgcgcaauaucacaaucaggcgaacaaacucucuuaaugauagauaauaccacaugccccaccgccguacuaggcaauguaaucaucucauuagguaaauaccuaggaucagugaacuacaacucagaagguauagcaauugguccaccaguauuuacugacaaaguagacaucagcucacaaauauccucaaugaaucaaucauuacaacaaucaaaagacuauaucaaagaagcacaaagacucuuagacacaguaaacccaagcuuaauuagcaugcuauccaugaucauacucuauguacuuucaauagcaucccuuugcaucggacuaauaacuuuuaucucauucaucaucguagaaaaaaaacgaaacacuuacucaagacuagaagauagaagaguaagacccacaucaaguggagacuuauauuauauaggaacauaa

SEQ ID NO: 994 - RNA, 1617 nt, Artificial Sequence
  derived and/or modified CDS sequence (opt6) from Nipah henipavirus__CBM41033__HsIgE(1-18)_F(27-546)
auggacuggacauggauauuauuuuuaguagcagcagcaacaagaguacauucaauacuccauuacgaaaaacuuucaaaaauaggcuuaguaaaaggaguaacaagaaaauauaaaauaaaaucaaacccccuaacuaaagauauaguaauaaaaaugaucgcaaacguuucuaacaugucccaauguacaggaucaguaauggagaacuauaaaacaagauuaaauggaauauuaacaccaaucaaaggcgcacucgaaauauacaaaaacaacacacacgacuugguaggugauguacgacuagcaggagucaucauggccggcguagcaauaggaauagcuacagcagcacaaauaacagcaggaguagcauuauacgaagcaaugaaaaaugccgauaacauaaacaaauuaaaaucaucuauagaaucaacaaaugaagccguaguaaaacuacaagaaacagccgaaaaaacaguuuacguucuuacagccuuacaagauuauaucaauacaaauuuaguaccuacuaucgauaaaauauccugcaaacaaacagaacucucacucgaccuagcccucucuaaauaccuuucugauuuauuauucguauucggaccaaacuuacaagaucccguuucaaauuccaugacuauacaagcaauaagccaagcauuuggaggaaacuacgaaacacuucuaagaacauuagguuacgcaacugaagacuuugacgaccuacuagaaucagacucaaucacaggacaaaucaucuacguagacuuaucuucauacuacauaaucguccgaguauacuucccaauauuaacagaaauucaacaagccuauauacaagaacuacucccaguauccuuuaauaaugacaacucagaauggauaucaauagucccuaacuucauacuaguaagaaacaccuuaauuucaaacaucgaaauaggcuucugccuaauaaccaaacgaucaguaauaugcaaccaagacuacgcaacuccaaugacaaauaauaugcgagaauguuuaacaggaaguacagaaaaaugccccagagaauuagucguaucaucucaugucccaagauucgcacuaucaaauggaguacuauucgcaaacugcauaucaguaacaugucaaugucaaacuacuggccgugcaauaucucaaucaggagaacaaaccuuacucaugauagacaacacaaccugcccaacagcuguacuuggcaacguaauaaucucacuaggaaaauaccuaggaaguguaaacuauaacucugaggggauagcaauaggcccaccaguauucacagauaaaguagacauuagcucccaaaaaucaucuaugaaucaaucacuccaacaaucaaaagacuacauaaaagaagcacaacgcuuauuagacacaguaaauccaucacuaauaucaaugcuaucaaugauaauauuauacgucuuauccauagccagcuuauguauaggcuuaauaaccuucauauccuucauaaucguagaaaaaaaacgcaauaccuacucacgacucgaagacagacgaguaagaccaaccuccuccggagaccuauacuauaucggcacauaa

SEQ ID NO: 995 - RNA, 1617 nt, Artificial Sequence
  derived and/or modified CDS sequence (opt6) from Nipah henipavirus__AEZ01396__HsIgE(1-18)_F(27-546)
auggacuggacauggauauuauuuuuaguagcagcagcaacaagaguacauucaaucuuacacuacgaaaaacucuccaaaauaggccuaguaaaaggcauaacacgaaaauauaaaauaaaaucuaacccacuaacaaaagacaucguaauaaaaaugaucccaaacguauccaacaugucacaaugcacaggcucaguaauggaaaauuacaaaaccagacuaaauggcauuuuaacaccaauaaaaggagcacuagaaauuuacaaaaacaacacacacgaccuagucggagauguacgacuagccggagucauaauggcaggaguagcaauaggaauagccaccgcagcucaaauaacagcaggagucgcccuauaugaagccaugaaaaaugcugauaauauaaacaaauuaaaaucuucaaucgaaucaacaaacgaagcaguagucaaacuacaagaaacagcagaaaaaacagucuauguacuaacagcccuacaagacuacauaaacacaaauuuagucccuaccauagauaaaauaagcuguaaacaaacagaacucucacuagaccuagcccucucaaaauaccucucagaccuauuauuuguauucggacccaaccuccaagacccagucucuaacucuaugacaauacaagcgauaucccaagcauucggcgguaauuacgaaacauuacugcguacacuuggcuacgcaacagaagacuuugacgacuuauuagaaucagauucaauaaccggacaaauaauauacguagacuuauccggcuacuacauaauagucagaguauauuucccaauauuaaccgaaauccaacaagccuacauacaagaacuacuaccaguuucauucaacaaugauaacucugaauggaucucuaucguuccaaacuuuauuuuagugagaaacacccuaauaucaaacauugaaauaggcuucuguuuaauaacuaaaagaucaguuauaugcaaccaagacuacgcaacacccaugacaaauaacaugagagaaugccuaaccggcucaaccgaaaaaugcccacgagaauuagucguaucaucacacguaccacgcuucgcacucucaaauggaguccuuuucgcaaacugcauaucagucacuugucaaugccaaaccacaggcagagccauaucccaaucaggcgaacaaacccuacucaugauagacaauacaacauguccaacagcuguccucggcaauguuauaauaucccucggcaaauauuuagguucuguaaacuacaacucagaaggaauagcuaucggaccucccguauuuacagacaaaguagacaucucaucucaaauaucaucaaugaaccaaucccuacaacaaaguaaagacuacauaaaagaggcacaaagacuacuagacaccguaaacccguccuuaaucucuauguuaagcaugaucauacuauacguauuaucaauugcaucauuaugcauaggauuaauaacauucauuucauucauaauaguagaaaaaaaacgaaacaccuauucacgauuagaagaucgaagaguacgaccaacuagcuccggcgaccuauauuacaucggaacauaa

SEQ ID NO: 996 - RNA, 1617 nt, Artificial Sequence
  derived and/or modified CDS sequence (opt6) from Hendra henipavirus__NP_047111__HsIgE(1-18)_F(27-546)
auggacuggacauggauauuauuuuuaguagcagcagcaacaagaguacauucaauccuacacuacgaaaaacuaucaaaaaucggccuagucaaaggaauaacacguaaauacaaaauuaaaucuaacccacuaaccaaagacauaguaauaaaaaugauuccaaacguuagcaacgucucaaaaugcacaggaacagugauggaaaacuauaaaucaagacuaacaggaauacuaucccccauaaaaggugcaaucgaauuauacaacaacaauacccaugaucuaguaggagauguaaaauuagcuggaguugucauggccggcauagcaauaggaauugcaacagcagcccaaauaacagccggaguagcucuauaugaagcaaugaaaaacgccgauaauauaaacaaacuaaaaucgucaauagaaucaacuaaugaagcaguugucaaacuacaagaaacagcagagaaaacaguauacguccucacagcuuuacaagauuauauaaacacaaacuugguacccacaauagaucaaauaucuuguaaacaaaccgaacuagcacuagaccuagcacuguccaaauaccucucagaucuucuauucguauucggcccuaaccuacaagaccccguuucaaacucuaugacaauucaagcaauaucacaagccuucggaggaaacuacgaaacacuacucaggacacucgguuaugcaacagaagacuuugaugaucuucuugaaucagauucaauagcaggucaaauuguauacguagauuuauccucauacuacauaauaguaagagucuacuucccaauauuaacugaaauucaacaagcauacgugcaagaauuacuaccaguaucauucaacaacgauaacucagaauggauaaguauaguaccaaauuucguacucauaagaaauacucuaauaucaaacauagaagucaaauauugcuuaauuacaaagaaauccguaaucuguaaccaagacuacgcaacccccaugacagcaucugucagagaaugucucaccggaucaacagauaaaugcccacgagaauuaguaguauccucacacguaccuagauucgcauuaucaggcggaguccuauucgcaaauugcauaucuguaacaugccaaugccaaacaacaggacgugcaauaucccaaucaggagaacaaacacuauuaaugauagacaauacuaccuguacaaccguaguacucgguaacauaauaauaagucuaggaaaauauuugggaaguauaaacuacaauucagaaucaauagcaguaggaccacccguauacacagauaaaguagacauauccucacaaauuucaucgaugaaucaaucacuccaacaauccaaagacuacaucaaagaagcacagaaaauacuagacacaguaaaccccucacuuauauccauguuauccaugauaauucuauacguucucuccaucgcagcccuaugcauaggauuaauaacuuucauuucauucgucauaguagaaaagaaaagaggaaacuauaguagauuagaugacagacaagucagaccagucucaaacggcgauuuauacuacauaggcacauaa

SEQ ID NO: 997 - RNA, 1617 nt, Artificial Sequence
  derived and/or modified CDS sequence (opt6) from Hendra henipavirus__AEB21233__HsIgE(1-18)_F(27-546)
auggacuggacauggauauuauuuuuaguagcagcagcaacaagaguacauucaauacuacauuaugaaaaauuauccaaaauaggauuaguaaaaggaauuacaagaaaauacaaaauaaaaagcaauccucuaacaaaagacauaguaauaaaaaugauccccaauguaucuaacguaucaaaaugcacaggaacagucauggaaaauuacaaaucaagacuaacuggaauucuaucaccaauuaaaggcgcuauagaacuauacaauaauaacacacacgaucuuguaggcgacguaaaguuagcgggaguuguaauggcaggaauugccauagguaucgcaacagcagcccaaauaaccgcaggcguagcacuauacgaagccaugaaaaaugcagauaacauaaauaaauuaaaauccaguauugagucaacaaaugaagcaguaguaaaacuccaagaaacagcagaaaaaacagucuauguacucacagcccuucaagauuacaucaauacaaaccuaguaccaacaauagaccaaauaucauguaaacaaaccgaauuagcacuagaccuagcacuuucaaaauacuuaagugaccuuuuauuugucuucggccccaaccuacaagacccaguauccaacaguaugacaauacaagccauaagucaagcauucggagguaacuacgaaacccuccuaagaacccuaggauacgcaacagaagacuuugacgaccucuuagaaagcgauucaaucacaggacaaauaguuuacgucgacuuaucuaguuacuacauaauaguaagaguauacuuccccauucuaacugaaauucaacaagcauacguacaagaauuacuaccaguaucauucaacaacgacaacucagaauggaucucaauaguuccaaacuuuguacuaauucgaaauacacuaaucucaaauauagaaguaaaauacugccuuauaacaaaaaaauccguaauaugcaaccaagacuaugcaacaccaaugaccgcaucaguucgagaaugccucaccgguuccacagauaaauguccaagagaauuaguaguaucuucacacguaccaagauucgcuuuaucaggaggcguucuauuugcaaacugcaucagcgucacaugccaaugucaaacaacuggccgagcaauaucacaaucuggagaacaaacacucuuaaugauagacaacacuaccugcacaacaguaguacucggaaacaucauaauaucacuuggaaaauaccucggaucaauuaacuauaacagugaaucaaucgcuguuggucccccaguauauacagacaaagucgacaucagcucacaaauuucaucaaugaaccaaucacuucaacaaucaaaagauuauauaaaagaagcacaaaaaauacuagacacaguaaacccaucuuuaauuucaauguuaucaaugauaauauuauauguucuaucaauugccgcacuaugcauuggauuaauaaccuuuauaucuuuuguaauaguugaaaaaaaaagagguaauuauucucgccuugacgaucgccaaguacgcccaguauccaacggugaccucuauuauauuggaaccuaa

SEQ ID NO: 998 - RNA, 1620 nt, Artificial Sequence
  derived and/or modified CDS sequence (opt6) from Hendra henipavirus__AEQ38114__HsIgE(1-18)_F(26-546)
auggacuggacauggauauuauuuuuaguagcagcagcaacaagaguacauucaggaauucuacauuacgaaaaacuuagcaaaauaggacuaguaaaaggaauaacccgaaaauacaaaauaaaaucaaacccccuaacaaaagacauaguaauaaaaaugauaccaaaugucucaaacgucagcaaaugcacaggcaccgucauggaaaauuacaaaucacgacuaacaggaauauuaucaccaauaaaaggagcaaucgaacuauacaacaacaacacacacgaucuaguaggcgacguaaaacuagcaggaguagucauggccggaauagcaauaggaaucgcaacagcagcucaaauaacagcaggaguagcacuuuacgaagcuaugaaaaacgcagacaauauaaacaaacuaaaaucaucaaucgaaucaacaaacgaagcuguuguaaaauuacaagaaacagcugaaaaaacuguauacguccuaacagcccuccaagauuacaucaacacaaacuuagucccaacaauugaucaaauuucaugcaaacaaacagaacuagcucuagaucuagcccuaucaaaauaccuaucugaccuacuauuuguauucggucccaauuuacaagaucccguaucaaauucaaugacaauacaagcaauuagccaggcuuucggaggaaauuaugaaacacuacuacgcacacuaggauacgcgacagaagacuuugacgacuuauuagaaucugauucaauaaccggucaaaucguauauguagacuuaagcucuuacuacaucauaguuagaguauacuucccaauccucacagaaauacaacaagccuacguccaagaauuauuaccaguaucuuucaacaacgacaacucagaauggauaucaauaguuccaaacuucguuuuaauaagaaacacacuaaucucaaauauagaagucaaauacugcuuaauaaccaaaaaaucaguaauaugcaaccaagauuacgccacaccaaugaccgcuucaguacgagaaugccuaacaggaucaacagauaaaugccccagagaauuaguuguaucaucccacguuccaagauucgcacuaucaggaggaguacuuuucgcaaauugcauaucaguuacuugccaaugccaaacaaccggacgcgcaauuucucaauccggagaacaaacacuacuaaugaucgacaacacaaccugcacaacaguaguacuaggaaauauuauaaucucacuaggcaaauacuuagguucuauaaacuauaacagugaaucaauagcuguaggaccaccaguauacacagacaaagucgacauuucuucacaaauuucuucaaugaaucaauccuuacaacaaaguaaagacuauauaaaagaggcacaaaaaauacuugacaccguaaaucccucacuuauaucaauguuaucaaugaucauccucuacguacuaucaaucgcagccuuaugcauaggacuaauaacauuuauuucauuuauaauaguagaaaaaaaacgaggcaauuacaguagacuagacgacagacaaguacgaccuguaucaaauggugaccucuacuacauaggaacauaa

SEQ ID NO: 999 - RNA, 1617 nt, Artificial Sequence
  derived and/or modified CDS sequence (opt6) from Hendra henipavirus__AAB39505__HsIgE(1-18)_F(27-546)
auggacuggacauggauauuauuuuuaguagcagcagcaacaagaguacauucaauacuacacuacgaaaaauuaaguaaaaucggccuagucaaaggaauuacccgaaaauacaaaaucaaaucuaacccauuaaccaaagacauagucauaaaaaugauuccaaacgucucaaacguaucaaaaugcacuggaaccguaauggaaaacuauaaaucacgauuaaccggaauacuaucaccaauuaaaggagcaaucgaacuuuauaacaauaacacacacgaccuaguuggcgacguaaaacuugcagguguaguaauggcagguaucgccaucggaauagcaacugcagcucaaaucacagccggaguagcucucuacgaagccaugaaaaacgcagacaauauaaacaaauuaaaaucaagcauagaaucaaccaacgaagcaguuguuaaacuucaagaaaccgcugaaaaaaccguauauguucuaacagcacuacaagacuauauaaacacaaaccuaguacccacaaucgaucaaauuuccugcaaacaaaccgaacuagcccuugaucuugcacucagcaaauauuuacucauauguucauguuucggcccaaaucuacaagauccaguauccaauucaaugaccauacaagcaaucucacaagcauuuggagguaacuacgaaacacuccuaagaacauuaggcuacgcuacagaagauuucgaugaccuccucgaaucagacuccauaacaggacaaauaguauacgucgaccuaucauccuacuacauaauagucagagucuacuucccaauacuaacagaaauucaacaagcauauguacaagaacuacuaccugucucauucaacaacgacaacucugaauggauauccauaguccccaauuuuguccuaauaagaaacacacuaaucucaaacauagaaguuaaauauugcuuaauaaccaaaaaaucagucauauguaaccaagacuacgcaacaccaaugaccgcaucaguaagagaauguuuaacagguaguacagacaaauguccaagagaauuaguaguuagcucccacguaccaagauuugcacuaucaggcggcguacuauucgcuaacugcauaaguguaacaugucaaugccaaaccacugggcgagcaaucucacaaucucgagaacaaacacuucuaaugauagacaacacaacaugcaccacaguaguucuaggcaauaucauaaucucacuaccaaaauacuuaggauccauaaaacuucaaguacuaagagcuuuacuccucggccaccaaucaauccaaaccaaaguugacauaucuucacaaauaucaucaaugaaucaauccuuacaacaauccaaagacuauaucaaagaagcacaaaaaauuuuagauacuguuaaccccaguuuaauaucuaugcuaucaaugauuauauuauacguccucaguauagcagcauuaugcauaggacucauaacauuuauaucauucguaauaguugaaaaaaaacgaggaaauuacucaagacuugacgacagacaaguaagaccaguaucaaauggagauuuauacuacaucggcacuuaa

SEQ ID NO: 1000 - RNA, 1653 nt, Artificial Sequence
  derived and/or modified CDS sequence (opt6) from Nipah henipavirus__AAK50554__HsIgE(1-18)_G(70-602)
auggacuggacauggauauuauuuuuaguagcagcagcaacaagaguacauucacaaaacuauacacguucuaccgauaaucaagcuguaauuaaagacgcauuacaaggaauucaacaacaaauaaaaggccuugccgacaaaauaggcacagaaauuggcccaaaaguaucuuuaauugacaccucaaguaccauaaccauacccgcuaauauaggacuauuaggcucaaaaauaucacaaucaacugcaucaauuaaugaaaacguaaacgaaaaaugcaaauuuacacuaccaccucuaaaaauccaugaaugcaacauaucuugcccaaaccccuuaccauuuagagaauaccgcccacaaacagaaggcguaucaaaccuaguaggccuacccaacaacauaugccuacaaaaaacaucuaaccaaauuuuaaaaccaaaauuaauaucuuacacauuaccagucgucggacaaagcggaaccugcauuacagacccacuacuagcaauggacgaaggauacuucgcauauucacaucuagaacguauaggaucauguucacguggugucucaaaacaacgaauaauaggaguaggcgaaguauuagaucgaggagacgaaguuccguccuuauucaugacaaaugucuggaccccaccaaaccccaacacaguguaccacugcucagcaguuuacaauaacgaauuuuauuacguacuaugcgcaguuucaacagucggagacccaauacuaaacaguacauauuggagcggaucauuaaugaugacaaggcucgccgucaaaccaaagagcaacggugguggauacaaucaacaccaacuagcacuaagaucaauagaaaaaggaagauacgacaaaguaaugccauacggcccaucaggaaucaaacaaggagauacauuauacuucccagcagucgguuuucuaguaagaacagaauuuaaauacaacgauucaaauuguccaaucacaaaaugccaauauucaaaaccagaaaacugcagacuaucgaugggaauacgcccaaacucccacuacauacuuagaucuggacuauuaaaauacaauuuaagcgauggagaaaacccaaaaguagucuucauugaaauaucagaccaaagacuaucaauaggaucaccaucaaaaauauaugacucacuaggacaaccaguauucuaccaagcuucauucucaugggauacaaugauuaaauuuggagauguauuaaccguaaaucccuuaguaguaaauuggagaaauaacacuguaauuucuagaccaggacaaagccaauguccgagauucaauacaugucccgaaauaugcugggaaggaguauacaaugacgcauuccuaaucgaucgaaucaacuggauaagugcaggcguauuccuagacucaaaucaaacagcagaaaacccagucuucacaguauucaaagacaaugaaauacucuauagagcacaacucgcuucagaagacacuaaugcacaaaaaacaauaacaaacuguuuuuuacucaagaacaaaaucuggugcauuucauuaguagaaaucuacgacacaggagacaaugucauuagaccaaaacuauucgcagucaaaauaccagaacaauguacauaa

SEQ ID NO: 1001 - RNA, 1653 nt, Artificial Sequence
  derived and/or modified CDS sequence (opt6) from Nipah henipavirus__AEZ01389__HsIgE(1-18)_G(70-602)
auggacuggacauggauauuauuuuuaguagcagcagcaacaagaguacauucacaaaauuacacaagaucaacagacaaucaagccaugauaaaagacgcucuacaaagcauucaacaacaaauuaaaggcuuggcagacaaaauaggcacagaaauaggcccaaaaguaagcuuaauagacaccucuaguacaauuacaauacccgcaaauauaggguuauuaggaucaaaaauaagccaaaguacagccuccauaaacgaaaauguaaacgaaaaaugcaaauuuacucuaccaccacuaaaaauacaugaauguaauauauccugcccaaacccacucccauucagagaauacaaaccacaaacagaggguguaucaaauuuaguaggauuaccuaacaauauaugucuacaaaaaaccuccaaccaaauacuuaaaccuaaacuaauaucauacacacucccaguaguaggacaaagcggaacauguauaacagacccacuccuagcaauggacgaaggauacuuugcauauagucaccuagaaaaaauaggaucauguagccgaggcgucaguaaacaaagaauaauaggaguaggagaaguacuagaccgaggagaugaaguaccuucacuauuuaugacaaacguauggacuccuucaaacccaaauacaguauaucacugcucagccgucuacaacaaugaauucuacuacguguuaugcgcaguaucaguaguaggagauccaauauuaaacagcacauauuggucaggaucuuuaaugaugacaaggcuagcagucaaacccaagaacaacggagaaucauauaaccaacaccaauucgcacuaagaaacauagaaaaaggaaaauacgacaaaguaaugccauacggaccaucagguauuaaacaaggagacacccuuuacuucccagcagucggguuucuaguaagaacagaauuuaaauauaaugacucaaauugcccaauagcagaaugucaauauuccaagccagaaaauugccgacucuccaugggaauaagaccuaacucacauuacauucuaagauccggacuucuaaaauacaauuuaucagaugaagaaaauaguaaaauaguauucauagaaauuagcgaucaacggcuuucaauaggaucaccaucaaaaaucuacgauucauuaggccaacccguuuuuuaucaagcaucauucuccugggacacaaugauaaaauuuggagacguacaaacuguaaacccacuaguaguaaauuggagagacaacacaguaauaucacgacccggucaaucccaaugcccucgauuuaacaaaugcccagaaguaugcugggaaggaguauacaacgacgcauuucuuauugaccgcauaaacuggauaucagcaggugucuuccuagauucaaaccaaacugcugaaaaccccguauucacaguauucaaagacaacgaaguacucuacagagcucaacuagcaucugaagauacaaacgcacaaaaaaccauaacaaacugcuucuuauuaaaaaacaaaaucuggugcaucucacuaguagaaauauacgauacaggagacaaugucauaagaccaaaacuauucgcaguaaaaauccccgaacaaugcacauaa

SEQ ID NO: 1002 - RNA, 1653 nt, Artificial Sequence
  derived and/or modified CDS sequence (opt6) from Nipah henipavirus__ACT32615__HsIgE(1-18)_G(70-602)
auggacuggacauggauauuauuuuuaguagcagcagcaacaagaguacauucacaaaacuauacaagaucaacagacaaucaagccaugauaaaagacgcuuuacaauccauccaacaacaaauaaaaggacuagcagauaaaaucggcacagaaauaggaccuaaaguaucucugauagauacuucaucaacaauaacuauaccagccaauauaggucuucuggguucaaaaauaucacaauccacugccuccaucaacgaaaacguaaaugaaaaaugcaaauuuaccuuacccccauuaaaaauacacgaaugcaacauaucauguccaaacccacuaccauucagagaauauaaaccucaaacagaaggagucucaaaccuaguuggcuuaccaaauaacaucugccuacaaaaaacauccaaccaaauauuaaaacccaaacuaauuucauacacacuuccaguaguaggacaauccggaacuuguauaacagaccccuuacucgcaauggacgaaggauacuuugcauauucccaccucgaaaaaaucggaucuugcucacgaggcguaucaaaacaacgaauuauaggaguaggagaaguauuagacagaggugaugaagucccaucauuauuuaugacaaacguauggacuccaagcaacccaaacacaguauaucacuguuccgccgucuacaauaacgaauucuacuaugucuuaugcgcuguaucaguaguaggugaccccguucuaaacucaacauacuggucuggcucacuaaugaugacaaggcuagccguaaaaccaaaaaauaacggagaaucauauaaucaacaccaauucgcacuaagaaacauagaaaaaggaaaauacgacaaagucaugccuuacggcccuuccggaauaaagcaaggagacacacuauauuuuccagccguagguuucuuaguacgaacugaauuuaaauauaacgacucaaacugccccaucgcugaaugucaauauucaaaaccagaaaauugcagacuaucaaugggaauaagaccaaauucacacuacauacuaagaagcggacuccuuaaauacaacuuaucagaugaagaaaacucuaaaauagucuucauagaaauauccgaccaaagacuauccauaggaucaccaucaaaaauauacgacucacuaggucaaccaguauucuaccaagccagcuucucaugggacaccaugauuaaauucggugauguacaaacagucaauccccuaguugucaacuggcgagacaauacaguaauauccagaccaggacaaucucaaugccccagauucaacaaaugucccgaaguauguugggaaggaguuuauaacgacgccuuucuaauagacagaaucaacuggauuucugcuggcgucuuccuagauucaaaccaaacagcagaaaacccaguauuuacuguauucaaagacaaugaaguacuauaccgugcacaauuagcaucugaagacacaaacgcacaaaaaacaaucacaaacugcuuucuacuaaaaaauaaaauauggugcauaucacuagucgaaauauacgacacaggcgacaacgucaucagaccuaaacuauucgcugucaaaauacccgaacaauguacauaa

SEQ ID NO: 1003 - RNA, 1653 nt, Artificial Sequence
  derived and/or modified CDS sequence (opt6) from Nipah henipavirus__CAF25497__HsIgE(1-18)_G(70-602)
auggacuggacauggauauuauuuuuaguagcagcagcaacaagaguacauucacaaaauuauaccagaucuacagauaaucaagcaguuauaaaagaugcacuucaaggaauacaacaacaaauaaaaggucuagcagacaaaauaggaaccgaaauaggaccgaaagucucacuaauagacacuucaucaacuaucacaauaccagcaaauauaggccuacuaggaucaaaaauaagucaaagcacagcaucaauaaaugaaaauguaaacgaaaaaugcaaauuuacacucccaccccuaaaaauacaugaauguaacauaucaugcccaaacccacuacccuuucgagaauaccgcccucagacagaaggcgucuccaaccucguaggauuaccaaacaauauaugccuccaaaaaacuagcaaucaaauucuaaaaccaaaacuaauaucuuacacauuaccaguaguaggacaaucaggcacaugcauaacagacccacuuuuagcaauggacgaaggauacuucgcauauucacauuuagaacguauuggaucaugcucaagaggaguauccaaacaaagaauaauaggaguaggcgaaguccuagaccgaggcgaugaaguacccucccucuucaugacaaacgucugggcaccuccaaacccaaacacaguuuaucauugcuccgcaguauacaauaacgaauucuacuacguccuaugugcaguauccacagucggcgacccuauauuaaacuccacuuacuggagcggaucauuaaugaugaccagacuagccguaaaacccaaaaguaacggcgguggauauaaccaacaccaauuagcauuacguucaauagaaaaagggagauacgauaaaguaaugccauacgguccaucaggaauaaaacaaggagacacacuauacuuucccgcagucggcuucuuagucagaacagaauucaaauauaacgacucaaacugucccauaacaaaaugccaauauucaaaaccugaaaacugcagacuaucaaugggaauccgaccaaauucucacuacauccuuagaucaggcuuacugaaauauaaucucucagacggagaaaauccaaaaguaguauucaucgaaauaucagaucagagacuaucaauuggaucacccaguaaaauauacgacucucucggacaaccaguauuuuaccaagcuuccuucucaugggauacaaugauaaaauucggagacguacucacaguaaauccacucguaguaaacuggagaaauaauacaguuaucucacgucccggacaaucacaaugcccaagauucaacacauguccagaaauaugcugggaaggaguauacaaugaugcauuuuuaauagaccgaauaaauuggauaagugcaggaguauuuuuagacucaaaccaaacagcagaaaaccccguuuuuacaguauucaaagauaacgaaauauuauaccgugcccaacuagcaucugaagacacaaaugcacaaaagacuaucacuaauugcuuucuauuaaaaaacaaaauaugguguauaucuuuagucgaaauauacgauacaggagauaacguaauaagaccaaaacuguucgcaguaaaaauuccugaacaaugcacauaa

SEQ ID NO: 1004 - RNA, 1653 nt, Artificial Sequence
  derived and/or modified CDS sequence (opt6) from Nipah henipavirus__CBM41034__HsIgE(1-18)_G(70-602)
auggacuggacauggauauuauuuuuaguagcagcagcaacaagaguacauucacaaaauuauacucgauccacagauaaccaagcugucauaaaagacgcauugcaagguauacaacaacaaauaaaaggucuagcugacaaaauuggaacagaaauaggaccaaaaguaucacugauagacacaucaucaaccauaaccauaccagcaaauauaggccuacuaggauccaaaauaucacaaagcaccgcauccauaaacgaaaacguaaacgaaaaaugcaaauuuacauuaccaccgcuaaaaauacaugaaugcaauauaucaugcccaaauccacuaccauucagagaauaccgaccacaaaccgaaggaguaagcaaucuaguaggacuaccagauaauauaugcuuacaaaaaacaucaaaucaaauccucaaaccaaaauuaauaucuuauacccuaccaguaguaggacaaagcgguaccugcauaacagacccacuacuagcuauggaugaaggauacuuugcuuacagccaccuagaacgaauaggaaguuguaguagaggaguaucaaaacaaagaauaauaggaguuggcgaagucuuagauagaggcgacgaaguaccaucacucuucaugacaaauguauggacacccccaaauccaaauacaguauaccacuguuccgcaguauacaauaaugaauucuacuacguauuaugcgcaguaagcacaguaggagauccaauacuaaauaguacauacuggucaggaucacuaaugaugacaagauuggcaguuaaaccaaaaucaaacggaggaggcuacaaucaacaccaacuagcacuaagaaguauagaaaaagguagauaugacaaaguaaugccauacggucccucaggaauaaaacaaggugacacacuauauuuuccagcagucggauuucucguaagaacagaauuuaaauauaaugauucaaacugcccaauuacaaaaugccaauauucaaaaccagaaaacuguagacuauccaugggaauaagaccaaacucucauuacauacuaagaucaggacuccucaaguauaacuuaucugauggagaaaaccccaaaauagucuuuauagaaaucucagaccaacgcuuaagcauagguucaccaucaaaaguauacgauagccuaggccaaccaguauuuuaccaagcaucauuuaguugggacacaaugauaaaauucggugauguucaaacaguaaaucccuuagucgucaauuggcgagauaacacaguaauaucuagacccggacaaagccaauguccacgauuuaacacauguccagaaauauguugggaaggcgucuauaacgacgcguucuuaauagacagaauaaacuggauaucagccggaguauuccuugacagcaaucaaacagcagaaaacccaguauuuacagucuucaaagauaaugaaauacuauaucgagcucaacuagcuagcgaagacacaaaugcacaaaaaaccauaaccaauugcuucuuacuaaaaaacaaaauauggugcauaucacuaguagaaauauacgauacgggagauaacgucauacgaccaaaacucuucgcaguaaaaauaccagaacaauguacauaa

SEQ ID NO: 1005 - RNA, 1653 nt, Artificial Sequence
  derived and/or modified CDS sequence (opt6) from Nipah henipavirus__AAX51853__HsIgE(1-18)_G(70-602)
auggacuggacauggauauuauuuuuaguagcagcagcaacaagaguacauucacaaaacuacacaagaagcacugacaaucaagcaguaauuaaagacgcccuacaaggaauacaacaacaaauaaaaggacucgcagacaaaauagguacugaaauaggccccaaagucagucuaauagacaccucaucaacaaucacaauaccugcaaauaucggccuauuaggaucaaaaauaucacaaucaacugccucaaucaacgaaaacguaaacgaaaaauguaaguucacacuuccaccucucaaaauacacgaauguaauauaucaugccccaacccacuaccauuucgagaauacagaccucaaacagaaggaguuucuaaccuaguuggcuuaccaaauaacauaugucuucaaaaaacuuccaaucaaauacuaaaaccaaaacuaauaucauacacccuaccagucguuggccaaucaggaacauguauaacagauccacuauuagcaauggacgaaggauacuucgcauacucacaccuagaaagaauaggaucuuguucaagagguguaucaaaacaaaaaauaauaggaguaggagaaguucuagaccgaggagacgaaguaccaucgcuauucaugacaaaugucuggacaccacccaacccaaauacaguauaucacugcagugccguauacaacaaugaauuuuacuauguccuaugcgcagucucaacaguaggagacccaauccuaaacuccacauacuggucaggaagucuuaugaugacucgucucgcagucaaaccaaaguccaacgacggaggauauaaccaacaucaauuagcccuaagaagcauagaaaaaggaagauacgacaaagucaugccauacggccccucaggaauuaaacaaggagauacauuauauuucccagcaguaggauuucuaguacgaacagaauucaaauacaacgauucaaauugccccauaacaaaaugccaauacaguaaaccagaaaacugucgacuuagcaugggaauacgaccaaacucucacuauguacuaagaucuggccuccuaaaauauaaucuaucagacggugaaaaccccaaaauaguauucauagaaauauccgaccaaagauuauccauaggaucaccaucaaaaauauaugacuccuuaggucaaccagucuuuuaccaagcaucuuuuuccugggacacaaugauaaaauucggagauguacaaacaguaaacccucuaguuguaucuuggagagacaacacaguaauaucacgcccuggccaaucacaaugcccacgcuucaacacauguccagaaauaugcugggaaggcguauacaacgacgccuuucucauagacagaauaaacuggauaucagccggaguauuccuagacuccaaucaaacagcagaaaauccaguauuuacuguauucaaagauaacgaaauauuguacagagcacaacuagcaagugaagauaccaacgcccaaaaaacaaucaccaacugcuucuuauuaaaaaacaaaauauggugcaucucacuaguagaaauauaugauacaggcgacaauguaaucagaccaaaauuauucgcaguaaaaauacccgaacaaugcacauaa

SEQ ID NO: 1006 - RNA, 1653 nt, Artificial Sequence
  derived and/or modified CDS sequence (opt6) from Nipah henipavirus__AEZ01397__HsIgE(1-18)_G(70-602)
auggacuggacauggauauuauuuuuaguagcagcagcaacaagaguacauucacaaaacuacacucguucaacagacaaucaagcaaugaucaaagacgcacuacaauccauucaacaacaaauaaaaggcuuagcagacaaaauuggcacagaaauaggaccaaaaguaucacuaauagacaccagcaguacaauaacaaucccugccaacauaggccuauuaggaucaaaaauaucacaauccacagcauccauaaaugaaaauguaaacgaaaaaugcaaauuuacacuaccaccacuaaagauucacgaaugcaauauaucuugcccaaauccacuaccauucagagaauauaaaccccaaaccgaaggagucuccaaucucgucggccuaccuaacaacaucugcuuacaaaaaacauccaaccaaauauuaaaacccaaauuaauaucauacacacuaccaguaguaggacaauccggaacaugcauuacagacccacuacucgccauggacgaaggauauuuugcauauucacacuuagaaaagauaggaucauguucaagaggagucucuaaacaaagaauaaucggcgucggugaaguccuagauagaggagaugaaguccccucgcuauucaugacaaacgucuggacaccaucaaauccuaauacaguauaccauuguucugcagucuauaacaacgaauucuacuaugucuuaugcgcaguaucaguagugggagacccaauccuaaacuccacauacuggucaggaagccuaaugaugacacgacuagcugugaaaccaaaaaauaacggugaaucauacaaccaacaucaauucgcauuacgaaacauagaaaaaggcaaauaugacaaaguaaugccauauggaccauccggaauaaaacaaggcgacacauuauauuuccccgcaguaggauuucuuguucgaacagaauuuacauacaacgauucaaacuguccaauagccgaaugccaauacucuaaacccgaaaauugccgucuaagcaugggaauacgaccaaacucacacuacauacucagaucaggauuacuaaaauacaaucucucagacgaagaaaacuccaaaauaguauucaucgaaauaucugaucaacgacuauccauuggcucacccucaaaaauauaugacucacuaggacaaccaguauucuaccaagccaguuuuucuugggacaccaugaucaaauucggagacguucaaacaguaaacccccucguaguaaauuggcgagacaauacaguaaucuccagaccaggucaaucgcaaugucccagauuuaacaaauguccagaagucuguugggaagguguauacaaugaugcauuucuuauagacagaauaaauuggauaucagcaggaguuuuuuuagacucuaaccaaaccgcagaaaacccagucuucacaguauucaaagacaaugaaguacuauaccgcgcacaauuagcaagcgaagacacaaacgcacaaaaaacuauaacuaauugcuucuuauuaaaaaacaaaauaugguguauaucucucguagaaauauacgauacaggagacaacguaaucagaccaaaauuauucgcaguaaaaauaccagaacaaugcacauaa

SEQ ID NO: 1007 - RNA, 1659 nt, Artificial Sequence
  derived and/or modified CDS sequence (opt6) from Hendra henipavirus__NP_047112__HsIgE(1-18)_G(70-604)
auggacuggacauggauauuauuuuuaguagcagcagcaacaagaguacauucacaaaauuacacaagaacuacagauaaucaagcccucauaaaagaaucccuacaauccguucaacaacaaaucaaagcccuuacagacaaaauaggaacagaaauagguccaaaaguaucacuaauugauacaucuucaacaauuacaauaccagcaaacauaggcuuauuaggaucuaaaauaucacaaucaacaagcucuauuaaugaaaacguaaaugauaaauguaaauucacccuaccaccacucaaaauacacgagugcaauauuucaugucccaacccauuaccauuuagagaauaucgaccaauaucucaaggaguuucagacuuaguaggacuaccuaaccaaauaugcuuacaaaaaacaacuucaacaauauuaaaaccacgccucauaucauacacacucccaauaaauacaagagaaggaguaugcauaaccgauccccuacuugcaguugacaacggcuucuucgcuuacucccacuuagaaaaaauagguucuugcacaagaggaauagccaaacaaagaauaauaggaguaggagaaguccuagacagaggagacaaaguaccaucaauguucaugacaaauguauggaccccaccaaacccaucuacaauacaccauugcucaucaaccuaccacgaagauuucuauuacacacuaugcgcaguaagccacguuggugaccccauacuaaacucaacuucauggacagaaucccuaagucuaauaagauuagcaguccgaccaaaauccgacucaggugauuauaaccaaaaauauauagcuaucacaaaaguagagcgaggaaaauacgauaaaguaaugccauauggaccauccggaauaaaacaaggcgauacacucuauuucccagcuguaggcuuccuaccacgcacagaauuucaauacaacgacucaaauuguccaauaauccacugcaaauacagcaaagcagaaaauugcagauuaaguaugggaguaaacaguaaaucacauuacauacuaagaucaggauuacuaaaauacaaccuaucucucggaggagacauaauauuacaauuuaucgaaauagcagacaaccgauuaacaaucggcucaccuuccaaaaucuacaacucacuaggucaaccaguauuuuaccaagcaaguuacucaugggacacaaugauaaaacuuggagacguagacacagucgauccccuacgcguacaauggagaaacaauucuguaauauccagacccggacaaucacaauguccacgauuuaacguaugucccgaaguaugcugggaaggaacauauaacgacgccuucuuaauagaccgacuaaacuggguaucugccggcguauaccuaaacucaaaccaaacagcagagaacccuguauuugccguauucaaagacaacgaaauacucuaccaaguaccauuagcagaagaugacacaaaugcacaaaaaacaauaacagacugcuuccuacuagaaaacgucauuuggugcauaucacuaguagaaauauacgacacaggagacagcguaauccgaccaaaacuuuuugcagucaaaauacccgcucaaugcuccgaaucauaa

SEQ ID NO: 1008 - RNA, 1659 nt, Artificial Sequence
  derived and/or modified CDS sequence (opt6) from Hendra henipavirus__AEB21225__HsIgE(1-18)_G(70-604)
auggacuggacauggauauuauuuuuaguagcagcagcaacaagaguacauucacaaaacuacacaagaacaacugacaaccaagcacugauuaaggaauccuuacaaucaguacaacaacaaauaaaagcacuaacagauaaaauuggaaccgaaauaggcccaaaaguaucacuuauugacacuucauccacaaucacaauaccagcaaacauaggacuccuaggcucuaaaauaucucaaucaaccuccuccauaaacgaaaauguaaacgauaaauguaaguucacacuacccccuuuaaaaauacacgaaugcaauauaucauguccaaacccacuuccauuccgagaauacagaccuauaucacaaggaguaucagaucuaguaggauuaccaaaccaaauaugucuccaaaaaacuacauccacaaucuuaaaacccagauuaaucucuuauacauuaccaauaaauacaagagaaggcgucugcauaacagaucccuuacuagcugucgacaacggcuucuucgcauauucacaucuagaaaaaauaggaagcugcaccagaggaaucgccaaacaacgaauaauaggaguaggcgaaguucuagaccgaggcgacaaaguuccaucaauguucaugaccaacguauggacccccccaaaccccucaacaauacaccauugcucaucaacuuaucacgaagacuucuacuacacccuaugcgcaguaucacacguaggagacccaauacuaaacucaacaagcuggaccgaaagucucucacuaauuagacuugcaguaagaccaaaaagcgauuccggcgauuacaaucaaaaauauauagcaauaacaaaagucgaacgaggaaaguacgauaaaguaaugccauacggaccaucaggcauaaaacaaggagauaccuuauauuucccagcagucggcuuuuuaccuagaaccgaauuccaauacaacgacucuaacugcccuauaauucacuguaaauauuccaaagcagaaaacugucgauuauccaugggagucaacuccaaaucacacuauauucuaagaaguggacuauuaaaauacaacuuaucacuuggaggagacaucaccuuacaauuuauagaaauagcagauaauagacucacaauagguagcccuuccaaaauauacaauucacuaggccaaccagucuuuuaucaagcaucauacucaugggauacaaugauaaaacuaggcgacguagacacaguagacccuuuaagaguccaauggagaaauaacucaguaauaucacgacccggccaaucccaaugcccacgauucaacguuuguccggaaguauguugggaaggcacuuacaacgacgcauuccuaaucgauagacucaacuggguaucugcugguguauacuuaaauuccaaucaaacagcagaaaauccaguauucgcagucuuuaaagacaacgaaauacuauaucaaguuccccucgcugaagacgacaccaacgcacaaaaaaccauaacagacuguuuuuuauuagaaaacguaauauggugcaucucuuuaguagaaauauacgauacaggagacucaguaauacguccaaaauuauucgcagucaaaaucccagcucaaugcuccgaaucauaa

SEQ ID NO: 1009 - RNA, 1659 nt, Artificial Sequence
  derived and/or modified CDS sequence (opt6) from Hendra henipavirus__AEB21216__HsIgE(1-18)_G(70-604)
auggacuggacauggauauuauuuuuaguagcagcagcaacaagaguacauucacaaaacuacacacgcacaaccgauaaccaagcacuaauaaaagaaucauuacaaucaguccaacaacaaaucaaagcccucaccgauaaaaucggcacagaaauaggccccaaaguuucacucauagauacaucuaguaccauaaccaucccagcaaacaucggucuauuaggaucaaaaauaucacaaucaacauccucaauaaaugaaaaugucaacgauaaaugcaaauucacauuaccaccauuaaaaauccacgaaugcaacauaucaugucccaacccacucccuuucagagaauaccgcccaauaucccaaggagucucagacuuagucggauuaccaaaccaaaucugccuacaaaaaaccacaucuacaauacuaaaaccaagauuaaucucuuacacauuaccaauaaauacccgagaaggagucugcauuacugaccccuuacuagcuguagacaacggcuuuuuugcauacagccacuuagaaaaaaucgguuccugcacuagaggaauagcaaaacaaagaaucauaggaguaggcgaaguacuagaucgaggcgauaaaguaccaucaauguuuaugacaaaugucuggacacccccaaacccauccaccauccaccauugcucaucaacauaucacgaagacuucuauuacacacuuugcgcaguaagccacguaggugaccccauucuuaauucaacaucuuggacagaaucccuuucacucaucagacuagcaguaagaccaaaauccgacucaggagacuauaaccaaaaguauauagccauaaacaaagucgaaagaggaaaauacgauaaaguaaugccauauggcccauccggcauaaaacaaggagacacccuauauuuuccagccguaggcuuccuaccucgcacagaauuccaauauaacgauuccaacugcccaauaauacauugcaaauauucaaaagcagaaaacugcagacuaucaaugggaguaaacucgaaaucacacuacauccuuagaucaggccucuuaaaauacaaucuaucccuaggcggagacaucauauuacaauuuauugaaauagcagacaauagacuaacaauaggaucaccaucaaaaauauacaacucucuaggccaaccaguauucuaucaagcaucuuauucaugggauaccaugaucaaacuaggugaugucgauacuguugaucccuuacgaguucaauggagaaacaacuccguuauaucacgucccggucaaucacaaugucccagauucaaugucugcccugaaguauguugggaaggcacauauaacgaugccuucuuaauagaucgacuaaauuggguaucagcaggcguauaucuaaacucaaaccaaacagcagaaaacccaguauuugcaguuuucaaagacaaugaaauacucuaccaaguaccauuagcagaagaugacacaaaugcacaaaaaacuauaacagacuguuucuuauuagaaaacguaauaugguguauaaguuuaguagaaauauacgacaccggagacucuguaauaagacccaaacucuuugcaguaaaaauaccagcccaaugcucugaaucauaa

SEQ ID NO: 1010 - RNA, 1659 nt, Artificial Sequence
  derived and/or modified CDS sequence (opt6) from Hendra henipavirus__AEB21206__HsIgE(1-18)_G(70-604)
auggacuggacauggauauuauuuuuaguagcagcagcaacaagaguacauucacaaaacuacacacgcacaaccgacaaccaagcacuaauaaaagaaagucuacaaucuguccaacaacaaauaaaagcacuaacugauaaaauuggaacagaaauaggccccaaaguaucucuaaucgacacaucaucaacaauaacaauaccagccaacauaggacuauuaggcucaaaaaucagccaaucaaccagcaguauaaaugaaaaugucaaugacaaaugcaaauucacauuaccaccucuaaaaauacacgaaugcaacaucucaugcccaaacccacuaccauuuagagaauacagaccaauaucccaaggaguaucugaccuaguaggccuaccuaaccaaauaugucuacaaaagacaacaucaacaauuuuaaaaccaagacuaauauccuacacauuaccaauuaacacaagagaaggcgucugcauaacagauccacuauuagccgucgacaauggauucuucgcauacagccaccucgagaaaauaggcucaugcacaagaggaauagccaaacaacgcauaauaggaguaggugaaguauuagaccgaggagacaaaguaccaagcauguuuaugacaaacguauggacuccuccaaacccaucaacaauacaccacuguucaaguacauaccaugaagacuuuuacuacaccuuaugugcaguaucacacgugggagaccccauacucaauucuacuucauggacagaaucacuaucucuaauaagauuagcaguaagaccaaaauccgacucuggaaacuauaaccaaaaauacauagcaauuacaaaaguagaaagagguaaauacgacaaaguaaugccauauggaccaucagguaucaaacaaggcgauacucuauacuucccagcagucggauuucuuccaagaacagaauuucaauacaaugacaguaacuguccaauuauacauuguaaauacucaaaagcagaaaauuguagacucucaaugggagucaacaguaaaucccacuacauauuacguucaggacuucuaaaauauaacuuaucauuaggcggcgacauaauccuacaauucauagaaauagccgacaacagacuuacaauaggaucaccaagcaaaauuuauaacucauuaggucaaccuguauucuaccaagcaucauacuccugggacacuaugauuaaauuaggagacauagacaccguagacccacuuagaguacaauggaggaacaacucuguaauauccagaccuggacaaagccaaugucccagauucaauguaugucccgaagucuguugggaaggaacguacaaugacgcauuccuaauagaccgccuaaacuggguaucagcuggaguauaccuaaacucaaaucaaaccgcagaaaaccccguauucgcaguauucaaagauaaugaaauauuauaccaaguaccucuagcagaagacgacacaaacgcacaaaagaccauaaccgacugcuuccugcuagaaaaugucaucuggugcaucagcuuagucgaaauauacgauacaggagacagcguaauacgacccaaacuauuugcagucaaaauaccagcacaaugcucugaauccuaa

SEQ ID NO: 1011 - RNA, 1659 nt, Artificial Sequence
  derived and/or modified CDS sequence (opt6) from Hendra henipavirus__AEQ38052__HsIgE(1-18)_G(70-604)
auggacuggacauggauauuauuuuuaguagcagcagcaacaagaguacauucacaaaacuauacucgaaccacagacaaucaagcccuuauaaaagaaucacuacaaucaguacaacaacagaucaaagcauuaacagauaaaauaggaacagaaauaggaccaaaaguaucucuaaucgacacaucaucaacaaucacuauaccagcaaacaucggauuacuaggaucaaaaaucucccaaucaaccucauccauaaacgaaaauguaaacgauaaaugcaaauuuacauuaccaccccucaaaauacacgaaugcaacauaucuugcccuaaccccuuacccuuccgcgaauaucgccccauaucacaagguguuucugauuuaguaggauuacccaaucaaauaugucuacaaaaaacaacaucaacaauucuaaaaccaagauuaaucucauacacacuuccaauaaauaccagagaaggaguaugcauaacagauccacuacucgccguagauaacggcuucuuugcauauucacaucuagaaaaaauaggaucauguacccguggaauagcuaaacaaagaauaauuggcgucggagaaguacuagauagaggagacaaagucccuuccauguucaugacaaauguauggacuccaccaaacccaucaacaauacaccauugcuccucuaccuaccacgaagacuuuuacuacaccuuaugcgcagucucccauguaggcgacccaauacugaacucaacaucauggacagaaucacuaucucuuauacgauuagccgucagacccaaaucugacucaggagauuauaaucaaaaauacauaacaauaacaaaaguugaaagaggaaaauacgauaaagucaugcccuacggaccauccggaauaaaacaaggagacacacuauauuucccagcaguaggcuucuuacccagaaccgaauuucaauacaacgacucaaauugcccaauaauccacuguaaauauucaaaagcugaaaauugccgauuaagcaugggaguaaauaguaaaucacacuacauauuaagaucaggacuucuaaaauacaaccuaucauuaggaggcgacauaauauuacaauuuauagaaauagcagacaaccgcuuaacaaucggaucaccaaguaaaauauacaacucacuagggcaaccaguuuuuuaccaagcaucauacucaugggacacaaugauaaaacuaggagauguagauacaguagaccccuuaagaguacaauggagaaacaacucaguuauaucucgaccaggacaaucacaaugcccuagauucaauguaugcccagaaguauguugggaaggaacauauaacgacgcauuuuuaauagaucgccuaaauuggguuucagcuggcguauacuuaaacucaaaucaaacagcugaaaaccccguauuugccguauucaaagacaaugaaauauuauaucaaguaccucuagcagaagacgauaccaaugcacaaaaaaccauuaccgacuguuuucuacucgaaaacguaaucuggugcauaucauuaguugaaauauacgauacaggcgacucagucauaaggcccaaauuauucgcaguaaaaauaccagcucaaugcuccgaaagcuaa

SEQ ID NO: 1012 - RNA, 1659 nt, Artificial Sequence
  derived and/or modified CDS sequence (opt6) from Hendra henipavirus__AEQ38115__HsIgE(1-18)_G(70-604)
auggacuggacauggauauuauuuuuaguagcagcagcaacaagaguacauucacaaaacuacacaagaacaacugacaaccaagcccuaauaaaagaaucccuacaaucaguacaacagcaaauaaaagcauuaacagacaaaauaggaacagaaauaggaccaaaaguuagucuaauugacacgucaaguacaauaacaauuccagcaaauauaggucuauuaggaucuaaaauaucucaaucuaccucuucaauaaacgaaaacguaaacgauaaaugcaaauucacuuuaccuccacuuaaaauccacgaaugcaacauaucaugucccaacccccuacccuucagggaauacagaccuauaucacaaggaguaagugaucuaguaggccuaccaaaccaaauaugucuucaaaaaacuaccucaacaauccucaaaccacgacuaauauccuauacauuaccaauuaacacucgcgaaggaguauguauaacagacccacuucuagcaguagacaacggauucuucgcauacucucacuuagaaaaaauaggauccuguaccagaggaauagccaaacaaagaauaauaggaguaggcgaaguuuuagauagaggagauaaaguaccuuccauguucaugacaaauguauggacaccacccaacccaagcacaauacaucacugcucaagcacauaucaugaagacuucuacuacaccuuaugcgcaguaucucauguaggcgacccuauacuaaacuccacuucauggacagaaucacuaagccuaaucagacucgcuguacgaccuaaaucagauaacggagacuauaaccaaaaauauaucgcgaucaccaaagucgaaagaggaaaauacgauaaaguuaugccuuacggacccucuggaauaaaacaaggagacacacuauacuucccagcaguaggcuuucucccccgaaccgaauuccaauacaaugauucuaauugcccuaucauacauugcaaauacuccaaagcagaaaacuguagguuauccaugggaguaaauucuaaaucccacuauauccucagaucaggcuuacuaaaauacaacuuaucacuagguggcgauauuauauuacaauucauagaaauugcagacaacagauuaacuauuggaucacccucaaaaauauauaauucacucggacaaccaguauucuaccaagcaucguacucaugggacaccaugauaaaauuaggcgacgucgauacaguagacccacuaagaguacaauggagaaauaauuccgucauaucacgaccaggccaaucucaauguccaagauucaauguauguccagaagucugcugggaagguacauacaacgacgcuuuccuaauagauagauuaaacuggguaucagcaggagucuaccuaaacagcaaccaaacagcugaaaauccuguauucgcaguauuuaaagacaacgaaauacuauaccaaguaccacuagcagaagaugacacaaaugcacaaaaaacuauaacagacuguuuccuacuagaaaacguaauaugguguaucucacucgucgaaauauacgacacaggagacagcguaauaagaccaaaacuauuugccguaaaaaucccagcacaaugcucagaauccuaa

SEQ ID NO: 1013 - RNA, 1659 nt, Artificial Sequence
  derived and/or modified CDS sequence (opt6) from Hendra henipavirus__AEQ38108__HsIgE(1-18)_G(70-604)
auggacuggacauggauauuauuuuuaguagcagcagcaacaagaguacauucacaaaacuauaccagaacaacugacaaucaagcacuaauaaaagaaucacuacaaucuguacaacaacaaauaaaagcacuaacagauaaaaucggaacagaaauaggucccaaaguaagucuaauugauacaucaucuacuauuaccauucccgcuaacauaggacuacuaggaucuaaaaucucacaauccacgucaucuauaaacgaaaauguaaaugacaaauguaaauucacccuaccaccacucaaaauucacgaauguaauauaucauguccuaacccacuuccauucagagaauauagacccauaucccaaggaguauccgaccuuguaggauuacccaaucaaauaugccuccaaaaaacaacgucaacaauacuaaaaccacgauuaauaucuuacacacuacccauaaacacacgagaaggaguaugcauaacagauccccuauuagcugucgacaauggauuuuucgcuuacucucaccuagaaaaaauagguucuugcacaagaggcaucgcaaaacaaagaauaaucgguguaggagaaguccucgacagaggagauaaaguaccaucaauguucaugacuaauguuuggacuccaccaaacccauccaccauacaccauugcuccagcacauaucaugaagacuuuuacuauacacuaugugccguaucacacguaggagaucccaucuuaaacagcacaagcuggacagaaucacuaucacucauaagacuagcaguuagacccaaaucagauucaggugacuauaaucaaaaauacauaacaauaaccaaagucgaaagaggaaaauacgauaaaguaaugccauacgggcccucagguauaaaacaaggcaacacauuauauuucccagcaguaggauuuuuaccaagaacagaauuucaauacaacgacucaaacugucccaucauacacuguaaauauuccaaagcagaaaauugcagacuaagcaugggaguaaacuccaaaagccacuacauacucagaucaggacuacuaaaauacaaccuaucacucggaggugauauaauccuacaauuuauugaaauagccgacaaccgucuaacaaucggaucaccaucaaaaaucuacaacucacuaggacaacccguauucuaucaagcuagcuauucaugggacacaaugauaaaauuaggagacguagacacagucgacccccuacgaguccaauggcgaaacaacucagucauaucaaggccuggacaaucgcaauguccacguuuuaacguaugccccgaaguuugcugggaaggaacauacaaugacgcauuucuuaucgauagacucaauuggguauccgccggcguauacuuaaacucaaaccaaacagcagaaaacccugucuuugcaguauucaaagauaaugaaauacuuuaccaaguaccacucgcagaagacgauacaaacgcacaaaaaacaauaacagauuguuuucuacuugaaaaugucauaugguguauaucacuaguagaaaucuaugauacaggagacucaguaauuagaccuaaacuauuugcaguaaaaauaccugcacaaugcuccgaaucguaa

SEQ ID NO: 1014 - RNA, 1659 nt, Artificial Sequence
  derived and/or modified CDS sequence (opt6) from Hendra henipavirus__AAV80426__HsIgE(1-18)_G(70-604)
auggacuggacauggauauuauuuuuaguagcagcagcaacaagaguacauucacaaaacuacacaagaacaacagauaaccaagcucuaauaaaagaaucacuacaauccguccaacaacaaaucaaagccuuaacugauaaaaucggaacagaaauaggacccaaaguauccuuaauagacacuucaucaacaauaacuauaccagcuaacauaggacuauuaggcagcaaaauuucucaaugcacaucuucuaucaaugagaacguaaaugacaaaugcaaauucacccuuccuccauuaaaaauucacgaaugcaacauaucgugucccaauccacucccauuuagagaauaucgaccaauaucccaaggcguaucagaucuaguaggccucccaaaccaaauuugccuacaaaaaacaacaucuacaauacuaaaaccccgcuuaauaagcuauacucuaccaauaaacacacgcgaaggcguaugcaucacugauccccugcucgcaguagauaacggguucuucgcauauagccaccuugaaaaaauaggaucauguacuagaggaauagcaaaacaaagaauaauaggaguaggagaaguccucgauagaggagauaaagugcccagcauguucaugacaaacguauggacaccaccaaacccuucaacaauccaccacuguucaucaacauaccaugaagacuucuauuauacacuaugcgcaguaucucacguaggagacccaauauuaaacuccacaagcuggacagaaucacuaucccucauaagacuugcuguaagacccaaaucugacuccggagacuacaaccaaaaauacauagcaauaacaaaaguagaaagaggaaaauacgauaaagucaugccauacggaccaaguggaauaaaacaaggagacacacuauacuucccagcuguaggauuccucccccgaacagaauuucaauacaacgauucuaacuguccaauaauacacugcaaauauuccaaagcugaaaacugccgauuaucaauggggguuaacucaaaaucacacuacauacuaagaucaggacuacuaaaauacaaccuaucacucggcggagacauaauacuccaauuuauugaaauagccgacaaucgacuaacaauaggaucaccaaguaaaaucuacaacucacuaggucaaccagucuucuaucaagccuccuacucaugggacaccaugauaaaacuaggagauguagacaccguagauccauuacgcguacaauggagaaauaacuccgucaucagucgacccggacaaucacaauguccacgauuuaauguaugcccagaaguauguugggaaggcucauauaaugaugcauuccuaauagacagacuuaauuggguaucagcaggaguauaccuaaauucaaaccaaacagcagaaaacccuguauuugccguauucaaagacaaugaaauuuuauaucaaguuccacuagcagaagacgacaccaacgcacaaaaaacaaucacugacugcuuucuacuagaaaacguuaucugguguauaaguuuaguagaaaucuaugauacaggagacucaguaauaagacccaaacuauucgccgucaaaaucccagcacaaugcucagaaagcuaa

SEQ ID NO: 1015 - RNA, 1617 nt, Artificial Sequence
  derived and/or modified CDS sequence (opt11) from Nipah henipavirus__AAK50553__HsIgE(1-18)_F(27-546)
auggauuggacguggauacucuuucucguggccgcggccacgcgcgugcacucgauccuccauuacgaaaaacuaucaaaaaucggccucgucaaaggcguaacccgcaaauacaagauaaaaucaaacccgcuaaccaaagacaucguuaucaaaaugaucccaaacgucuccaacaugucccaaugcaccggcuccgucauggaaaacuacaaaacccgccuaaacggaauccucaccccaaucaaaggagcacucgaaauuuauaaaaauaacacccacgaccuagucggcgacguccgccuagcaggcguaaucauggcaggcgucgccaucggcauagccaccgccgcacagaucaccgccggugucgcccucuacgaagcaaugaaaaacgcugacaacaucaacaaacucaaauccuccaucgaauccacaaacgaagccgucguaaaacuacaagaaaccgccgagaaaaccgucuacguacucacagcccuccaagacuacauaaacaccaaccuaguacccaccauagacaaaaucuccuguaagcaaaccgaacuuagccuagaccucgcccucucuaaguaccucucagaccuccucuucguauuugguccuaaucuacaagacccgguauccaacucaaugacaauccaggccaucucccaagccuucggcggcaacuacgaaacccuccuacgcacccucggcuacgcaaccgaagacuuugacgaccuccuagaauccgacuccaucacaggccagaucauuuacgucgaccucucauccuacuacaucauaguaagagucuacuuccccauccucaccgagauccaacaagccuacauacaagaacuccuaccggucuccuucaacaacgacaauuccgaguggaucagcauaguccccaacuucauccucguacgaaacacccucaucagcaacaucgagauuggcuucugccucauaaccaaacgcuccgucaucugcaaccaagacuacgcaacccccaugaccaacaacaugcgugaaugccucacaggcagcaccgaaaaaugccccagagagcucguagucuccucccacgucccacgauucgcccuauccaacggcguccucuucgcaaacugcauuuccguuaccugccaaugccaaaccacaggacgggccaucucgcagucuggcgaacagacccuacuaaugaucgacaacacaaccugccccaccgccgucuuaggcaacgucaucaucucccugggaaaauaccucggcuccguuaacuacaacuccgaaggcaucgcaaucggaccucccgucuucaccgauaaagucgacaucuccagccaaaucuccuccaugaaucaaucucuccaacaaucaaaagauuacauaaaagaagcccaacgacuccucgacaccguaaaccccucacucaucagcauguuaucaaugaucauucuguacguacucuccaucgcgucccuaugcauaggccugaucaccuucaucucauucauaaucgucgaaaagaaacguaacaccuacucccgccuagaagaccgccgcguacgccccaccuccucuggggaccucuacuacaucgguaccuaa

SEQ ID NO: 1016 - RNA, 1617 nt, Artificial Sequence
  derived and/or modified CDS sequence (opt11) from Nipah henipavirus__AEZ01388__HsIgE(1-18)_F(27-546)
auggauuggacguggauacucuuucucguggccgcggccacgcgcgugcacucgauacuucacuacgaaaaacuguccaaaaucggccuugucaaagguaucacccguaaauacaaaauaaaaucaaacccccucaccaaagauaucgucauaaaaaugauccccaacgucucgaacaugucccaauguaccggcuccgucauggaaaacuacaagacccgccucaacgguauccuaaccccaauaaaaggcgcccuagaaaucuacaaaaacaacacccacgaccucgucggcgacguacgccucgccggcgucaucauggccggcguagccaucgggaucgccacagcagcccaaaucaccgccggcguugcccucuacgaagcaaugaaaaacgccgacaacaucaacaagcucaaaagcucaaucgaauccaccaacgaggccguagucaagcuccaggaaacagccgagaaaacugucuacguccuaaccgcacuccaagacuauauaaauaccaaccuaguaccaaccaucgacaaaaucagcugcaaacagacagaacugucccucgaccuagcccucagcaaauaccugagcgaccuacucuuuguauucggacccaaccugcaggaccccguuucaaacucaaugacaauacaagccaucucccaagccuucggcgggaacuacgaaacacuacugagaacccucggguacgccaccgaagacuucgacgaccuuuuagaauccgauagcauaaccggacaaaucaucuacguugaccuaagcggcuacuacauaauaguccgcguuuacuucccaauacucacagaaauucaacaagccuacauacaagaacuacucccaguguccuucaacaacgacaacuccgaauggaucuccauaguccccaacuucauccucgucaggaauacacuaaucagcaacauagagaucggcuucugccuaaucaccaaacguagcguaaucugcaaccaagacuacgccaccccuaugacuaacaacaugcgcgaaugccucaccgguucaaccgaaaagugcccacgagagcucgucgucuccucccacgugccccgcuucgcccucagcaacggcguccucuucgcaaacugcaucuccgugacaugccaaugccagacaaccggccgagccauuagccagucaggcgagcagacccuccucaugaucgacaacacaaccugcccaaccgccguccugggcaacgucauaauaucacugggcaaauaccucggaucugucaacuacaacucugaaggaauagccauaggcccacccguauucaccgauaaaguagacaucagcucccaaaucuccagcaugaaccaaagccuccaacaauccaaagacuacauuaaagaagcacaacgccuccucgacaccgucaaccccucauuaaucucaaugcucuccaugaucauccuauacguacugagcaucgccucccucugcaucggacuaaucaccuuuaucuccuucaucaucgucgaaaagaaacgcaacaccuacucgcgccuagaagaccgccgcguccgccccaccuccuccggugaccuguacuacaucggcaccuga

SEQ ID NO: 1017 - RNA, 1617 nt, Artificial Sequence
  derived and/or modified CDS sequence (opt11) from Nipah henipavirus__AAY43915__HsIgE(1-18)_F(27-546)
auggauuggacguggauacucuuucucguggccgcggccacgcgcgugcacucgauccuacacuacgaaaaacucuccaaaauaggccuaguuaaaggcaucacucgcaaauacaagauuaaauccaacccccucacaaaagacaucgucaucaaaaugauccccaaugucuccaacaugucccaaugcaccggcuccgucauggaaaacuacaaaacucgccucaacggaaucuuaacccccaucaaaggcgcgcucgagaucuacaaaaauaacacccacgaccugguaggcgacguccgacuugcuggagucauaauggccggcguagccaucggcaucgcaaccgcggcccaaaucaccgcagggguugcccucuacgaggccaugaaaaacgccgacaacauaaacaaacuaaaauccagcaucgaauccacuaacgaagccguaguaaaacuccaggaaacggccgagaaaaccgucuacguacuuacagcccuucaagauuacauaaauacgaaccucguccccaccaucgacaagaucucaugcaaacaaaccgaacucucccuugacuuagcgcucuccaaauacuccagcgaccuacucuucguauucgggccuaaccuccaagacccaguaagcaacuccaugaccauucaagcaauaucacaagccuucgggggcaacuaugaaacccuacucagaacccucggcuacgccaccgaaggcuucgacgaccuucuagaaucagacucuaucacuggccagauaaucuaugucgaccuaagcggauacuauauuauuguucgcgucuacuuccccauccucaccgaaauccagcaagccuacauacaggaacuccuccccgucagcuucaacaacgacaacuccgaauggaucuccaucguccccaacuucauccucguucgcaacacccuaauaucaaacaucgaaaucggcuucugccuaaucaccaaacgcuccgucauaugcaaccaggacuacgccaccccaaugaccaacaacaugcgcgaaugccucacaggcuccaccgagaaaugcccacgcgagcuaguugucuccucacacgucccccgcuucgcauuaucaaacggcguacucuucgcaaauugcaucuccgucacaugccaaugccaaaccacaggccgugccauaucacaaucaggcgaacaaacccuucucaugaucgacaauacaaccugccccaccgccguacucgguaaugucaucaucucacugggcaaauaccuaggaucagucaacuacaacucagaaggcaucgccaucggcccacccgucuucaccgauaaagucgacaucuccucucaaaucuccuccaugaaccaaucacuccaacagagcaaagacuacaucaaagaagcacaacgacuccucgacaccgucaaccccucccuaauauccaugcucucgaugaucauccucuacguacucuccauagccagccucugcaucggccuaaucaccuucaucagcuucauaauaguagaaaagaaacgcaacacauauucccgacuggaagacagacgcguccgucccacauccucaggagaccuguacuacaucggaaccuaa

SEQ ID NO: 1018 - RNA, 1617 nt, Artificial Sequence
  derived and/or modified CDS sequence (opt11) from Nipah henipavirus__CAF25496__HsIgE(1-18)_F(27-546)
auggauuggacguggauacucuuucucguggccgcggccacgcgcgugcacucgauccuacacuaugaaaaacuaagcaaaauaggacucguaaaaggagucacccgcaaauacaaaauuaaaucuaacccacucacaaaagacauagucaucaagaugauccccaacgucuccaacaugucccaaugcaccggcucugucauggaaaacuacaagacccgacuaaacggcauccucaccccaauaaaaggcgcccuagaaauauauaaaaacaacacccacgaccuagucggcgauguucgacucgccggcgucaucauggccggcguagccaucggcaucgccacggcagcccaaaucaccgccggcgucgcccuauacgaagccaugaaaaacgccgacaacauaaacaagcucaagagcucgaucgaaucaacaaacgaagccgucgugaaacuacaagaaacagcagaaaagacaguauacguccucaccgcccuacaagacuacaucaacaccaaccuggucccaaccauagauaaaaucucaugcaaacaaacagaacucucacucgaccucgcccuaucuaaguaccuaucagaccuccucuucgucuucggccccaaccuacaagacccagucuccaacuccaugaccauccaagccauuucccaagccuucggcggcaacuacgaaacacuacuaagaacccucggcuacgcgaucgaagacuucgacgacuuacucgaaucagacuccaucaccggccaaaucaucuacgucgaccucuccucuuacuacaucaucguacgcgucuacuucccaauccucacagaaauccaacaggccuacauccaggaacuacuccccgucuccuucaacaacgacaacuccgaauggaucuccaucgucccgaacuucauccuaguccgcaacacucucauuuccaacauagaaaucggcuucugccucaucaccaagcgcucagucaucugcaaccaagacuaugcaacacccaugaccaacaacaugcgugaaugccucaccgguuccaccgaaaaauguccccgugaacucgucguaagcucccacgucccccgcuuugcccuauccaacggcguacucuucgccaacugcaucucaguaaccugccaaugccaaaccacgggucgagcaaucucacaaucaggcgaacaaacacuccuaaugaucgacaacacaaccugcccgaccgccgucuuaggaaacguaauaaucucacucggaaaguaccucgguuccgucaauuauaacucagaaggcaucgcuauaggucccccaguauuuaccgacaaggucgacauaaguagccaaaucuccuccaugaaccaaucccuacaacaauccaaagacuacauaaaggaagcccagcgacugcuagacaccgucaacccaucgcuaaucuccaugcuguccaugaucauccuauacguccugucaaucgccucucugugcaucggccucaucaccuucauaucuuucaucaucgucgagaaaaagcgaaacaccuacucacgacucgaagaccgacgcguccgcccuaccuccucgggugaucuuuacuacauaggcaccuga

SEQ ID NO: 1019 - RNA, 1617 nt, Artificial Sequence
  derived and/or modified CDS sequence (opt11) from Nipah henipavirus__AAM13405__HsIgE(1-18)_F(27-546)
auggauuggacguggauacucuuucucguggccgcggccacgcgcgugcacucgauacuacacuacgaaaaacucucaaaaaucggccuugucaaaggcgucacccgaaaauacaagaucaaauccaacccccucaccaaggacauugucauaaaaaugauacccaacgucuccaacaugagccaaugcaccggaagcgucauggaaaauuacaaaacacgucucaacgguauccucaccccgaucaaaggggcccuagagaucuacaagaacaacacacacgaccucgucggugauguacgacucgcaggcgucaucauggccggcgucgccaucgggaucgccaccgccgcccaaaucaccgcuggcgucgcucuuuaugaagccaugaaaaaugccgauaacaucaacaaacuuaaauccucuauugaauccaccaacgaggccgucgucaaacuccaagaaacagcugagaaaaccguguauguccucaccgcccuccaagacuacaucaacacaaaucucgucccuacaauagacaagaucucaugcaaacaaacagaacucucucuagaccuagcccucuccaaauaccuuagcgaccuacuauucguauucggacccaaccuccaagaccccgucuccaacucaaugacaauacaagccaucagccaggccuucggcggcaacuacgaaacacuccuucgcacccucggcuacgcuacagaagacuucgacgaccuacucgaauccgacucaaucaccggccaaaucaucuauguggaccucuccuccuacuacaucaucguccgcguauacuuuccaauccuaaccgaaauccaacaggccuauauacaagaacuccucccgguuuccuucaacaaugacaacuccgaauggauauccaucgucccaaacuucauccucguccgcaacacccuaaucagcaacaucgaaaucggcuucugccuuauaaccaaacgauccguuaucugcaaccaagacuacgccaccccaacaaccaacaacaugagagaaugccucaccggcuccaccgaaaaaugccccagagaacucgucguauccucccacguaccacgguucgcacuaucaaacggcguucuauucgccaacugcaucuccguaaccugccaaugccaaaccaccggccgcgcaauaucucaauccggcgaacaaacccuacuuaugaucgacaacacaaccugccccaccgccguccuaggcaacgucauaaucucccucggcaaauaccuaggcucagucaacuacaacagcgaaggcaucgccaucggaccucccgucuucacagacaaagucgacauauccucccaaaucuccaguaugaaccaaagccuacagcaaucaaaagacuacaucaaagaagcacaacgccuccucgacaccgucaaccccucccucauaucaaugcucucaaugaucauccucuacguccuuuccaucgccucccucugcaucggccuuaucaccuucauaucauuuaucaucgucgaaaagaaaagaaacaccuacucccgccucgaagaccgcagaguccgccccaccucgucaggcgaccucuauuauaucggcacauaa

SEQ ID NO: 1020 - RNA, 1617 nt, Artificial Sequence
  derived and/or modified CDS sequence (opt11) from Nipah henipavirus__CBM41033__HsIgE(1-18)_F(27-546)
auggauuggacguggauacucuuucucguggccgcggccacgcgcgugcacucgauccuccacuacgaaaaacucucaaaaauaggccuuguuaaaggcguaacccgcaaauacaaaaucaaauccaauccacugacaaaagacaucgucauaaaaaugaucgccaacguguccaacaugucucaaugcacaggcuccgucauggaaaacuacaaaacccgcuuaaacgguaucuuaaccccaaucaaaggagcacucgaaaucuacaaaaacaacacccacgaccuagucggcgacguccgacucgcuggcgucauaauggccggggucgcaaucggcaucgccaccgccgcccagauaaccgccggcgucgcacucuacgaagcaaugaaaaaugccgacaauaucaacaagcuaaaaucuagcaucgaauccaccaacgaagccgucgucaaacugcaagaaaccgccgagaaaaccgucuacguucucacagcccuacaagacuacaucaacaccaaccucguucccaccauagacaaaauaucgugcaaacaaaccgaacucucccucgaccucgcacuuuccaaauaccucucagaccuucucuucguguucggcccaaaccuccaagacccagucuccaacuccaugaccauacaagccauaucacaagccuucggaggcaacuacgaaacacuacuacgcacacucggcuacgccaccgaagacuucgacgaccuccuugaauccgacucgauuacaggccaaaucaucuacgucgaccuaagcagcuacuacauaaucguccgcgucuacuuccccauccucaccgaaauccaacaagccuacauccaagaacugcuccccgucagcuucaacaacgacaacucagaauggaucucuauuguaccuaauuucauccucguccgcaacacccucaucuccaauaucgaaauagguuucugccuaaucacuaaacgauccgucaucugcaaucaagacuacgccacccccaugacaaacaacaugagggaaugccucaccgggucaaccgagaaaugcccccgcgaacucgucgucuccucccacgucccucgauucgcgcucuccaacggaguccuauucgcaaacugcaucucuguaaccugccaaugccaaaccaccggacgcgcaaucucacaauccggugaacaaacucuccuaaugaucgauaacacaaccugccccaccgcuguacucggcaaugucauuauaucccuuggcaaauaccuaggaucggucaauuacaacuccgagggcauugccaucggcccucccguauucaccgacaaagucgacaucuccucccaaaagucauccaugaaccaaucucugcaacaauccaaagacuacaucaaggaagcccaacgccuccuagacaccgucaaccccucccucaucucaaugcucuccaugaucaucuuauacguacuaucuaucgccucccucugcaucggucucauuaccuucaucucuuucaucaucgucgaaaagaaacgaaacaccuacucacgccucgaagaccgccgcgugcgccccaccuccagcggagaccuuuacuacaucggcaccuaa

SEQ ID NO: 1021 - RNA, 1617 nt, Artificial Sequence
  derived and/or modified CDS sequence (opt11) from Nipah henipavirus__AEZ01396__HsIgE(1-18)_F(27-546)
auggauuggacguggauacucuuucucguggccgcggccacgcgcgugcacucgauacuccacuacgaaaaacuuuccaaaaucgggcucgucaaagggaucacgcggaaauacaaaaucaaaucgaacccgcucaccaaagacauaguaauaaaaaugauuccaaacgucucaaacaugucccaaugcaccggcucagucauggagaacuacaaaacccgacucaacggaauacuaaccccaaucaaaggcgcccucgaaaucuacaaaaacaacacacacgaccuaguuggcgacguacgacucgcaggcguaauuauggccggcgucgcaauaggcauugccaccgccgcccaaaucaccgccggaguagcacuauacgaagccaugaagaacgccgacaacaucaauaaacucaaaucuucaaucgaaagcaccaacgaagcagucgugaaacuacaagaaaccgcagagaaaaccgucuacguucuuaccgcacuacaagauuacauaaacaccaaccucguuccaacaaucgacaaaaucucaugcaaacagacugaacuaagccucgaccucgcucucucaaaauaccucuccgaccuccuauucgucuucggccccaaccuccaagaccccguaagcaacuccaugacaauccaagcaaucucucaagccuucggcggcaacuacgaaacccuucuccgcacucuaggcuacgccaccgaagacuuugacgaccuacuagaauccgacucgaucaccggacaaaucaucuacgucgaucucuccggcuacuacauuauaguuagggucuacuucccaauacuuaccgaaauccaacaagcauacauccaggaacuccuccccgucucuuucaacaacgacaacucggaauggauaagcaucguccccaacuucauccucguccguaacacccucauaucaaacaucgaaaucggcuucugccuaauuacuaaacgcuccgucaucugcaaccaagacuacgccaccccaaugacaaacaacaugcgcgaaugccucaccggcucaaccgaaaaaugcccgagagaacucgucgucucaucucacgucccacgcuucgcgcuauccaacggcguacuuuuugccaacugcauuuccguuacaugccagugccaaacuaccgguagagcaaucucccaaagcggagaacaaacccuccucaugaucgacaacaccacaugccccaccgccguccucggaaacgucaucaucagccucggcaaauaccucggcuccgucaacuacaauucagaaggcaucgccauaggcccucccguauucaccgacaaagucgacaucuccucccagaucucauccaugaaucaaucgcuucagcaauccaaagauuacaucaaggaagcccaacgccuccucgacaccgucaaccccucccucaucucaaugcucucaaugaucauccuauacguccucucaaucgccagccucugcaucggccuaauaaccuucaucucauucauuauaguagaaaagaaacgcaacaccuacuccagacuagaggaccgccgagucagacccaccucauccggagaccucuacuacaucggaaccuaa

SEQ ID NO: 1022 - RNA, 1617 nt, Artificial Sequence
  derived and/or modified CDS sequence (opt11) from Hendra henipavirus__NP_047111__HsIgE(1-18)_F(27-546)
auggauuggacguggauacucuuucucguggccgcggccacgcgcgugcacucgauccuccauuacgaaaaacuaucaaaaaucggacuuguaaaaggcaucaccagaaaauacaaaauaaaauccaacccucucaccaaagauauugucaucaaaaugauccccaacguauccaacgucuccaaaugcacgggaacagucauggaaaacuacaaaagcagacuaaccggcauccucucaccgaucaagggcgcaaucgaacucuacaacaacaacacccacgaccucgucggcgacguuaaacucgccggcguagucauggccggcaucgcaaucggcauagccacggccgcccaaaucaccgccggagucgcacuuuacgaagcaaugaaaaacgccgacaacauaaacaagcuaaaauccuccaucgaaagcacaaacgaagccgucgugaaacuccaagaaaccgccgagaaaaccgucuacguucuaaccgcccuucaagacuacaucaacaccaaccucguccccacaauugaccaaauuucaugcaaacaaacagaacucgcccuagaccuagcccucagcaaauaccucuccgaccuccucuucgucuucggccccaaccuucaagacccuguauccaacagcaugacuauacaggccaucucccaagcauucggcggcaacuacgaaacccuacuccgcacccucggguacgccacagaagauuucgacgaccuccucgaauccgacagcaucgccggccaaauaguuuacguagaccuguccuccuacuacaucaucguacgcgucuacuucccaauccuaaccgaaauucaacaagccuacguacaagaacuccuacccgucucauucaacaacgacaacuccgaauggaucucaaucgucccaaacuucguccucauacgaaacacacugaucuccaacaucgaagucaaauacugccucaucacaaagaaaagcgucaucugcaaccaagacuacgccacacccaugaccgccuccguccgagaaugccuaacagguuccaccgacaaaugcccccgcgaauuagucgucuccagccacguccccagguuugcacucuccggcggcguccuauucgccaacuguaucuccguuaccugccaaugccagacuaccggcagagccaucucccaauccggagaacaaaccuuacucaugauugacaacacaaccugcaccaccgucguccuagguaacaucaucaucucccucgggaaauaccuaggcuccaucaacuacaacuccgaauccauugcggucggaccucccgucuacaccgacaaaguagacaucuccucccaaaucagcuccaugaaccaaucccuccaacaaucuaaagacuacauaaaagaagcccagaaaauccucgacaccgucaaccccucccucauuuccaugcucuccaugaucauccucuacguucuauccauagccgcccucugcauuggccuaaucaccuucaucuccuucguuaucgucgaaaagaaacgcggaaacuacucucgucucgacgaccgccaaguccgccccgucagcaauggcgaccuuuacuacaucggaaccuag

SEQ ID NO: 1023 - RNA, 1617 nt, Artificial Sequence
  derived and/or modified CDS sequence (opt11) from Hendra henipavirus__AEB21233__HsIgE(1-18)_F(27-546)
auggauuggacguggauacucuuucucguggccgcggccacgcgcgugcacucgauccuccacuacgaaaaacucuccaaaauaggccucguuaaaggcauuacccggaaauacaaaaucaaaucgaacccccucaccaaagacaucgucaucaaaaugaucccuaacguaucaaacgucuccaaaugcaccgguaccgucauggaaaacuacaaaucccgacucaccgguauccucagcccuauuaaaggagccaucgaacuauacaacaauaacacccacgaccucgucggcgaugucaaacuggcaggcguugucauggccggaaucgccaucggcaucgcuacagccgcacaaauaaccgccggcguagcucuauacgaggccaugaagaacgccgauaacaucaacaaacuaaaaucauccauagaauccaccaaugaagccguagucaaacuccaagaaaccgcagaaaagaccguuuacguccucaccgcacuccaagacuacauuaacaccaaccuuguccccaccaucgaccaaauuuccugcaaacaaaccgaacucgcacucgaccucgcacucuccaaguaccuauccgaccuccuguucguauucggccccaaccuccaagaccccguauccaacuccaugaccauccaagccaucucccaagccuucggcggcaacuacgaaacccugcuacgaacgcucggcuacgcaaccgaagacuucgacgaucuccucgaauccgacuccaucaccgggcaaaucgucuacgucgaccugucauccuacuacaucauaguacgaguauacuuccccauccucaccgaaauccaacaagccuauguccaagaacuccuccccgucucuuuuaacaacgacaacagcgaauggaucucgaucguccccaacuucguccucauacgcaacacucuaauauccaauaucgaaguaaaauacugccucauaacaaagaaauccgucaucugcaaccaagauuacgccacaccuaugaccgccuccguacgagaaugccucaccggcucaaccgacaaaugcccccgugaacucgucguauccagccacguaccacgcuucgcccucucaggcggaguacuguucgcuaacugcaucucuguaacaugccaaugccaaacaaccggacgcgccaucucccaaucaggcgaacaaaccuugcucaugauugacaauaccacgugcacuacagucguucuaggaaacaucaucaucagccucggaaaauaccucggcuccaucaacuacaacucugaguccauugccgucgggccacccgucuacaccgacaaagucgacaucuccucucaaaucucauccaugaaccaaucccuacaacaguccaaagacuauaucaaagaagcccagaaaauccucgacaccgugaaccccucacuaaucucaaugcuaucuaugaucauccucuacguccuauccaucgcugcccucugcaucggccucauaaccuucaucagcuucguaauuguagaaaagaaacgcggcaacuacucacggcuagacgaccgccaaguccgacccguaucaaacggcgaccucuacuacauaggcaccuaa

SEQ ID NO: 1024 - RNA, 1620 nt, Artificial Sequence
  derived and/or modified CDS sequence (opt11) from Hendra henipavirus__AEQ38114__HsIgE(1-18)_F(26-546)
auggauuggacguggauacucuuucucguggccgcggccacgcgcgugcacucgggaauccuccacuacgaaaaacucucaaaaauugggcucgucaaaggcaucacccgaaaauacaaaaucaaauccaacccucucaccaaagacaucgucaucaaaaugauccccaacgucagcaacgucuccaaaugcaccggcacagucauggaaaacuacaaaucccgccucaccggaauacuaucuccuaucaaaggcgccaucgagcucuauaacaacaacacccacgaccucgucggcgaugucaaacuagccgggguuguaauggccggcauagccaucggcaucgcaaccgcugcacaaaucaccgccggugucgcccucuaugaagccaugaaaaacgccgacaacauaaacaaacuaaaaucuucaaucgaguccaccaacgaagccgucguaaaacuccaagaaaccgccgaaaaaaccguuuacguccucaccgcccugcaagacuacaucaacacaaaccucguacccaccaucgaucaaaucucaugcaaacaaaccgaacucgcucucgaccucgcccucuccaaauaccuuuccgaccuccucuucguauucggccccaaccugcaagaccccgucuccaacucaaugaccauucaagccauaucacaagccuucgggggcaacuacgaaacacuccuccgcacccucggcuacgcaaccgaagacuucgacgaccuacucgaauccgauucaaucacaggccaaauaguauacgucgaccuguccucauacuacaucaucguccgcgucuacuucccaauccucaccgagauccaacaagcauacguccaggagcuccuaccugucucuuucaacaaugacaacucagaauggauaucgauaguccccaacuucguccuuauccgcaacacacucaucagcaacaucgaagucaaauacugccuaaucaccaaaaaaucgguaaucugcaaccaagacuacgccacccccaugaccgccucaguucgagagugccuaacaggcuccacagacaaaugccccagagagcucgucguaucaucccacguaccucgcuucgcccuuuccggcggcguccuuuucgccaacugcaucuccgucaccugccaaugccaaacaaccggucgcgcgaucucacaaucgggcgaacaaacccuucuuaugauugacaacacaaccugcacaaccgucguacucggcaacaucaucaucucgcucggaaaauaccuaggcuccaucaacuacaacagcgaaagcaucgcugucggcccccccgucuacaccgacaaaguagacauuuccucccaaaucuccuccaugaaccaaucccuccaacaaagcaaagacuacaucaaagaagcccaaaaaauuuuagauaccgucaaccccucccucaucucaaugcuaucaaugauaauccuguacguacuguccaucgccgcccucugcaucggucucaucaccuucaucucauucauaauaguagaaaaaaaacgcggcaacuacucucgucucgacgaccgccaaguccgccccgucucaaacggugaccucuacuacaucggcacauga

SEQ ID NO: 1025 - RNA, 1617 nt, Artificial Sequence
  derived and/or modified CDS sequence (opt11) from Hendra henipavirus__AAB39505__HsIgE(1-18)_F(27-546)
auggauuggacguggauacucuuucucguggccgcggccacgcgcgugcacucgauccuccacuacgaaaaacuuuccaaaaucggccucgucaaaggcaucacccgaaaauacaaaaucaaaagcaacccccuuacaaaagauaucgugaucaaaaugaucccuaacgucuccaaugucucaaaaugcaccggaaccgucauggaaaacuacaaaucccgccuuaccggaauacucucccccaucaaaggcgcaaucgaacucuacaacaacaacacacaugaccucgucggugacguaaagcucgccggcguggucauggccggcauagccaucgguaucgcaacagccgcccaaaucacagccggaguagcacucuacgaagccaugaagaacgcagacaacaucaacaaacuaaagucaaguaucgaauccaccaacgaagcuguugugaaacuccaagaaaccgcagagaaaaccgucuacguccucacagcacuccaagacuacaucaacaccaaccuuguccccaccaucgaccaaaucuccugcaaacaaacugaacuagcccucgaccucgcccucuccaaauaccuccucaucugcucaugcuucggccccaaccuacaagaccccguuuccaacagcaugaccauccaagcuauaucccaagcauucggcggaaacuacgaaacccuacuucguacacucggcuacgccacagaagacuucgacgaccuccucgagucagacuccaucaccggccaaaucgucuacgucgaccucucuuccuacuacaucaucguacgcguauacuuccccauccugacagaaauacaacaagcauacguccaagaacuucuccccguuuccuucaacaacgacaacucagaauggaucagcaucguuccaaacuucguacucauacgcaacacccucaucuccaacauagaagucaaauacugccuaaucaccaagaaauccgucauuuguaaccaggacuacgccaccccaaugaccgcgucaguccgagaaugccucaccggaucuaccgacaaaugcccccgagaacucguugucuccagccacgucccgcgcuucgcccuauccggaggaguacuauucgccaacuguauaucaguaaccugccaaugccaaacuaccggccgcgcaaucucccaaucgcgcgagcaaacccuccucaugaucgacaacacaaccugcacaaccgucguccucggcaacauaauuauaucucucccaaaauaucuaggaucuaucaaacugcagguacuccgagcccuucugcuaggccaccaauccauacagaccaaaguugauauauccagccaaaucuccucaaugaaccagucccugcaacaauccaaagacuacauaaaagaagcccagaaaauccuagacaccgucaacccaucccucauauccaugcucucaaugaucauccucuacguccucuccaucgccgcgcugugcaucggacucaucacuuucaucagcuucgucaucgucgaaaagaaacgcggcaacuacucccgccuugacgaccggcaaguacggcccgucucaaacggcgaccuauacuacaucggaacguaa

SEQ ID NO: 1026 - RNA, 1653 nt, Artificial Sequence
  derived and/or modified CDS sequence (opt11) from Nipah henipavirus__AAK50554__HsIgE(1-18)_G(70-602)
auggauuggacguggauacucuuucucguggccgcggccacgcgcgugcacucgcaaaacuacacccgaucaacugacaaccaagccgucaucaaagacgcacuccaagguauccaacaacaaaucaaaggccucgccgacaaaauuggaaccgaaaucggccccaaagucagccucaucgacaccucaucaaccauaaccauacccgccaacauugggcuccucggcuccaaaauuucccagagcaccgccucaaucaacgaaaacgucaacgaaaaaugcaaguucacccucccaccccucaaaauccacgaaugcaacaucuccugccccaacccccuccccuuucgggaauaccgaccccaaaccgaaggcgucucuaaccucgucggccucccgaacaacaucugccuccagaaaacguccaaccaaauccucaaaccaaaacuuaucuccuacacccucccggucguaggccaaagcggaaccuguauuaccgacccccuccucgcaauggacgaaggcuauuuugcauacucccaccucgaacgaaucggaucaugcagccgaggcguauccaaacaacgaaucaucggcguuggcgaaguacuagaccgaggcgacgaggucccaucccucuuuaugacuaacgucuggacuccucccaaccccaacaccgucuaccacugcuccgccguauacaacaacgaguucuacuacguccucugcgcagucagcacagucggugaccccauccuaaacuccaccuacuggucaggcucacucaugaugacuagacuagccguaaaacccaaauccaacggcggaggcuacaaccaacaucaacucgcccuccgaagcaucgaaaaggguagauacgacaaagucaugcccuacggccccuccggcaucaagcaaggcgauacccucuacuuuccagccgucggauuccucguccgcaccgaguucaaauacaacgacucuaauugccccaucaccaaaugucaauacucaaagcccgaaaacugccgccucuccaugggcauccgucccaacucccacuacauccuccgauccggccuucuuaaguacaaccucucugacggagaaaaccccaaaguaguauucaucgaaaucucagaccaacgccucagcaucggcuccccauccaaaaucuacgacucccucggacaacccgucuucuaccaagcaaguuucucaugggacacaaugaucaaguucggggacguccugacaguaaacccccuagucgucaacuggagaaauaacaccgugaucucacgccccggccaaucccaaugcccccgcuucaauaccugccccgaaaucugcugggaaggugucuacaacgacgcuuuccuuauagaccgcaucaacuggaucuccgcaggaguguuccucgacuccaaccaaaccgccgaaaaccccguguuuacaguauucaaagacaacgaaauccucuaccgcgcccaacuagccuccgaggacacuaacgcgcagaaaaccaucaccaacugcuuccuccucaaaaacaagauauggugcaucucccuaguugaaaucuacgacacuggcgacaacgucauccgaccuaagcuguucgcaguuaaaaucccagaacaaugcaccuaa

SEQ ID NO: 1027 - RNA, 1653 nt, Artificial Sequence
  derived and/or modified CDS sequence (opt11) from Nipah henipavirus__AEZ01389__HsIgE(1-18)_G(70-602)
auggauuggacguggauacucuuucucguggccgcggccacgcgcgugcacucgcaaaacuacaccagaucaaccgacaaccaagcaaugaucaaagacgcccuccaaagcauccaacaacaaauuaaaggccucgccgacaaaaucggaacugagaucggccccaaaguuucccucauugacaccuccucaacaaucaccaucccagcgaacaucggacuacugggcuccaaaaucucacaauccacagccuccauaaacgagaacgucaacgaaaaaugcaaguucacacucccgccacuaaaaauacacgaaugcaacauauccugccccaacccccuccccuuccgcgaauacaaaccccaaaccgaaggcgucucgaaccucgucgggcuaccaaacaacaucugccuccaaaagaccucgaaccaaauacucaagcccaaacuuaucagcuacacccuccccguagucggccaaagcggaaccugcaucaccgacccccuccucgccauggacgagggcuacuucgcauauucccaccuagagaaaaucggcuccugcagccgcggcguaucgaaacaacgaauaauaggaguaggagaaguacucgaccgaggcgacgaagugcccucccuuuucaugaccaacguguggacacccucaaaccccaacacagucuaccacugcagcgcggucuacaacaacgaguucuacuacguccuaugcgcagucucaguagucggagaccccauacuaaacucuaccuacugguccggcucccucaugaugacccgccucgccguaaagccgaaaaacaacggcgaauccuacaaccaacaccaauucgcucuccgaaacaucgaaaaagguaaauaugacaaagucaugcccuacggucccuccgguaucaaacaaggcgacacccucuacuucccagccgucggcuuccucguccgaaccgaguucaaauacaacgacuccaacugucccaucgccgaaugucaauauucaaaacccgaaaacugccgacucuccaugggcauccgcccaaauucucacuacauccuccgcuccggucuccucaaauacaaccuauccgaugaagaaaacucgaaaaucgucuucauugaaaucuccgaccaacgccuauccaucggcucgcccucaaagaucuacgauucccuaggccaaccggucuucuaccaagccuccuucucaugggacaccaugaucaaauucggcgacguccaaacugucaacccacucgucguaaacuggcgcgacaacaccgucaucucaagacccggacaaucccaaugcccccgcuucaacaaaugcccagaaguaugcugggaaggcgucuacaacgacgccuuccucauagaucgcauaaacuggaucucagcgggaguuuuccuggacuccaaucaaacagcagaaaaccccguauucacugucuucaaagacaacgaaguucuauaucgugcccagcuugccuccgaagacacaaacgcacagaaaacaaucaccaacugcuuccugcucaaaaacaaaaucugguguaucucccucgucgaaauauaugacacaggcgacaacgucauacgcccaaaacuguucgccgucaaaauccccgagcaaugcaccuaa

SEQ ID NO: 1028 - RNA, 1653 nt, Artificial Sequence
  derived and/or modified CDS sequence (opt11) from Nipah henipavirus__ACT32615__HsIgE(1-18)_G(70-602)
auggauuggacguggauacucuuucucguggccgcggccacgcgcgugcacucgcaaaacuacacgcgcucaacugacaaccaagccaugaucaaagacgcccuacaaucgauacaacaacagaucaaaggccucgccgacaaaaucggaaccgaaaucgguccgaaagucucacuaaucgacaccucaucaaccaucacaauccccgcgaacaucggcuuacuaggcucaaaaaucucacagucaacagcaucaaucaaugaaaacgucaacgaaaaaugcaaguucacccugccuccccucaaaauccacgaaugcaacaucagcugccccaacccccuacccuuccgggaauacaagccccagacagagggcguaagcaaucuaguuggccuuccaaacaacaucugcuuacagaaaaccuccaaccaaauccuaaaacccaaacuuaucagcuacacacuccccguagucggacaaucaggaaccugcauaaccgacccccuucucgccauggacgaagguuacuucgccuacucccaccuagagaaaauaggcucaugcucacgcggagucuccaaacaacgcaucaucggagucggagaaguccuagaccgaggcgacgaaguccccagccucuucaugacgaacgucuggacaccgucgaaccccaacacaguguaccacugcagcgccguauacaacaacgaguucuacuauguccuaugcgccgucuccgucgucggagaccccguccuaaacuccaccuacugguccggcucccucaugaugaccaggcuggccguuaaacccaaaaacaacggcgaauccuacaaccaacaccaauucgcccuuagaaacaucgaaaaaggaaaauacgacaaagucaugcccuacggaccauccggaauaaaacaaggcgacacccuguacuucccagcugucggcuuccuaguucgaaccgaguucaaauacaacgauagcaacugccccaucgcugaaugucaguacuccaaaccugaaaacugccggcuauccaugggcauccgccccaacucacacuacauccuaagaucaggacuccucaaauacaaccucuccgacgaagaaaacucuaagaucgucuucauagaaaucucagaccaacgcuuaagcaucggcucuccauccaaaaucuacgacucacuaggacaacccgucuucuaccaagcauccuucucaugggacacgaugaucaaguucggcgacguacaaacagucaacccccuaguggucaacuggcgagauaacaccgucaucucucgaccuggacaaucccaaugcccacgauucaacaagugcccagaagucugcugggaaggaguauacaacgacgccuuccucauugaccguaucaacuggaucuccgcaggcgucuuccucgacucaaaccaaaccgcagaaaaccccguguuuaccgucuucaaagacaacgaaguccucuaccgcgcccaacucgcaagcgaagacaccaacgcccaaaagacaaucacaaacugcuuccuucuaaagaacaaaauauggugcaucucccuaguggaaauuuacgacaccggugacaacgucauccggcccaaacucuucgcagucaaaauccccgaacagugcaccuaa

SEQ ID NO: 1029 - RNA, 1653 nt, Artificial Sequence
  derived and/or modified CDS sequence (opt11) from Nipah henipavirus__CAF25497__HsIgE(1-18)_G(70-602)
auggauuggacguggauacucuuucucguggccgcggccacgcgcgugcacucgcaaaacuacacccgaucuacugacaaccaagcagucauaaaagacgccuuacaaggaauacaacaacaaaucaaaggacucgccgauaaaaucggcacugaaauaggccccaaagucagcuuaaucgacacaucauccacaaucacaauccccgccaacauaggucuacuugguuccaaaaucucccaaucaacagccucuaucaacgaaaacguaaacgaaaaaugcaaauucacccuacccccacucaaaauacacgaaugcaacaucuccugccccaacccccuccccuuccgcgaauaccgaccccaaaccgaaggcgucuccaaccucgucggccucccgaacaacauuugccuccagaaaacuagcaaucaaauccuaaaacccaaacucaucucauacacacugcccgucguaggccaaucgggaaccugcauaaccgacccccuccuagccauggacgaaggcuacuucgccuacucccaccuagaacggauuggcagcugcucccgcggcgucucaaaacaacgaauaaucggcguuggagaaguacuugaccgcggggacgaaguaccaucucuauucaugaccaacguaugggcaccaccuaacccuaacaccguauaccacugcuccgccguauacaacaacgaguucuacuacguccucugcgcagucucaaccguaggcgaccccauccucaacuccacuuacugguccggcucucucaugaugacccggcucgccgucaaacccaaauccaacggcgguggcuacaaccaacaccaacucgcucuccgauccaucgaaaaaggucgauacgacaaagucaugccguacggcccguccggcaucaagcaaggcgacacgcucuacuuccccgcagucggcuuccucguccgcaccgaguucaaauacaacgacucaaacugccccauaacaaaaugccaauacuccaaacccgaaaacugucgccucagcaugggcauccgaccaaacucgcauuacauccuacgauccggacuacuaaaguacaaccucuccgacggggaaaaccccaaaguuguuuucaucgaaaucuccgaccaacgccuuagcauaggauccccguccaagaucuacgacucgcuaggccagccagucuucuaccaagccaguuucuccugggacaccaugaucaaauucggcgacguccucaccgucaacccacuggucgucaacuggagaaacaacacugucauaucaagaccaggacaaucacaaugcccccgcuucaauaccugccccgaaauaugcugggaaggcgucuacaacgaugcauuccucaucgaccgaaucaacuggaucagcgccggcgucuuccucgacagcaaccaaacagccgaaaacccagucuucaccgucuucaaagacaacgaaauccucuaccgagcccaacuugccucagaagacaccaacgcccagaaaaccaucacaaacugcuuucuccucaaaaacaaaaucugguguaucucccuggucgaaaucuaugacacuggcgauaacgucauucgccccaaacuauucgcaguaaaaauccccgaacaaugcacauaa

SEQ ID NO: 1030 - RNA, 1653 nt, Artificial Sequence
  derived and/or modified CDS sequence (opt11) from Nipah henipavirus__CBM41034__HsIgE(1-18)_G(70-602)
auggauuggacguggauacucuuucucguggccgcggccacgcgcgugcacucgcaaaacuacacccgcuccaccgacaaccaagccgucauaaaagacgcacuccaaggcauccaacaacaaaucaaaggacucgccgacaaaaucggaacagaaaucggucccaaagucucucucauagacacauccucaacuauaaccauccccgccaacauaggauugcucggaucaaaaauaucgcaauccaccgccuccaucaacgaaaacgugaacgaaaaaugcaaauucacccuaccaccccuaaaaauccacgaaugcaacaucucaugccccaacccacugccauuccgcgaauaccgcccccaaacagaaggcguaucuaaucucgucggccugccagacaacaucugccuccagaagacguccaaccaaauccuaaaacccaaacucaucucauacacacuacccgucgucggccaauccgggacaugcaucacggacccccuccucgccauggacgaaggguacuucgcauacucacaccuagaacgcaucgguucaugcuccagaggcgucuccaaacagcgcaucaucggcgucggcgaaguccuggaccguggcgacgaaguacccucccuguucaugaccaacguauggaccccucccaaccccaacaccgucuaccacugcucagccgucuacaacaacgaauuuuacuacguccuuugcgcugucaguacuguaggcgauccuauccucaacucgaccuacuggucaggaucccucaugaugacgcgucuugcagucaaacccaaaucaaacggcggcggcuacaaccaacaccaacucgcccuacgcagcaucgaaaaaggccgauacgacaaagucaugccauacggucccuccggcauuaaacagggcgacacacucuacuuccccgccgucggcuuccucguuagaacagaguucaaauacaacgacucaaacugcccaauaacaaaaugccaauacucaaaacccgaaaauugccgccuauccaugggcauacgccccaacagccacuacauccuccgauccggccuacucaaauacaaccucucagacggcgaaaaccccaaaaucguauucaucgaaauauccgaccaacgacucuccaucggcucucccucgaaagucuacgacucacuaggacaaccagucuuuuaccaagcuagcuuuucaugggacaccaugaucaaguucggagacguacaaacaguuaacccucucguuguuaacuggcgcgacaacaccgucauaucccgacccggccaaucccaaugcccccgcuucaauaccugccccgaaaucugcugggaaggaguauacaacgacgccuucuuaaucgaccgaauaaacuggaucuccgccggcgucuuccucgacuccaaccaaacagccgaaaacccugucuucacuguauuuaaagacaacgaaauacuauaccgcgcccaacucgcaagcgaagacaccaacgcacagaaaacaauaaccaacugcuuccuccucaaaaauaaaauauggugcaucagccuggucgaaauuuacgacaccggagacaacgucaucagaccuaaacucuucgccgucaaaauccccgaacaauguacauga

SEQ ID NO: 1031 - RNA, 1653 nt, Artificial Sequence
  derived and/or modified CDS sequence (opt11) from Nipah henipavirus__AAX51853__HsIgE(1-18)_G(70-602)
auggauuggacguggauacucuuucucguggccgcggccacgcgcgugcacucgcaaaacuacacacgauccacugacaaccaagcugucauaaaagacgccuuacaaggcauccagcaacaaauuaaaggccucgcagacaaaaucggcacugaaauaggccccaaaguaucccuaauagauaccuccuccacaauaacuauaccagccaacaucggucuucuagguucuaaaaucucacaauccaccgcaagcaucaacgaaaacguaaacgaaaaaugcaaauucaccuugccaccccuaaaaauccacgaaugcaauaucuccugccccaacccccuccccuuccgagaguacagaccccaaaccgaaggcgucucgaaccucgucggccucccgaacaacauaugucuacaaaagaccucaaaccaaauccuuaaacccaaacucauaagcuacacgcuccccguagucggccaaucaggcacgugcaucacagacccccuacucgcaauggacgaaggcuacuucgccuacucucaccuggaacgcaucggcuccuguucuagaggcguauccaaacagaaaauaaucggggucggcgaaguccucgaccguggagacgaaguccccucccuauucaugacaaacguauggaccccacccaaccccaacaccgucuaccacugcuccgcaguuuacaacaacgaguucuacuacguacucugugcagucuccaccguaggcgaccccauacucaacuccaccuauuggagcggaucccuaaugaugacccggcucgccgucaaaccaaaaucaaacgacggcggcuacaaccaacaccaacucgcccuacgcucaauugaaaaaggccgauaugacaaagucaugcccuacggucccucuggcauaaaacaaggagauacacucuacuucccugcagucggcuuucucguacgcacagaguucaaauacaacgacucaaacugccccaucacuaaaugccaauacuccaaacccgaaaacugccgccucuccaugggaauccgccccaacucccacuacguccuccgauccggacuccucaaauacaaccuauccgacggcgaaaaccccaaaaucguauucaucgaaaucuccgaccaacgccuaucaauuggaucacccucaaaaaucuacgauucucucggucaacccguuuucuaccaagccucauucucgugggacaccaugauaaaguucggagacgugcaaaccgucaacccacucgucguauccuggcgagacaacacagucauaucccgcccgggacaaucccaauguccccgcuucaauacaugccccgaaaucugcugggaaggcgucuacaacgacgcauuccucaucgaccgaaucaacuggaucuccgccggcgucuuccuagacucgaaccaaaccgcagaaaaccccgucuucaccgucuuuaaagacaacgaaauccucuaccgcgcgcaacuagccuccgaagacacaaacgcccagaaaaccauaaccaacugcuuccuccucaaaaacaaaaucuggugcaucucacucgucgaaaucuacgacaccggcgacaacguuauccgccccaagcuauucgccguuaaaaucccagagcaaugcacauga

SEQ ID NO: 1032 - RNA, 1653 nt, Artificial Sequence
  derived and/or modified CDS sequence (opt11) from Nipah henipavirus__AEZ01397__HsIgE(1-18)_G(70-602)
auggauuggacguggauacucuuucucguggccgcggccacgcgcgugcacucgcaaaacuacacccgaagcaccgacaaccaagccaugauaaaagaugcccuucaauccauccaacaacaaaucaaaggccucgcagacaaaauagggaccgaaaucggacccaaagucucccuaaucgacaccuccucaaccaucacuauccccgcaaacaucggccuccuaggauccaaaaucucacaauccaccgcaagcauaaacgaaaacgucaacgaaaaaugcaaauucacccuaccaccccuaaaaauucacgaaugcaacaucucaugccccaauccccuaccauuccgcgaauacaaaccucaaaccgaagggguaucuaaccucgucggucuccccaacaacaucugccuccagaaaaccuccaaccaaauucucaaacccaaacuaauauccuacacacuccccgucguagggcaguccggcacaugcauaacggacccccuucucgccauggacgaaggcuauuucgcauacucccaucuggagaaaaucggcuccugcagccgcggcgucucgaaacaacgaaucaucggcguaggagaaguccucgaccgcggcgacgaagugccaagucucuucaugacaaacgucuggacccccuccaacccaaacaccgucuaccacugcuccgccguauacaauaacgaguucuacuacguccuaugcgcagugucugucgucggagacccgauucuaaacuccaccuacuggagcggcucacucaugaugacccgacucgcagucaaacccaaaaacaacggagaauccuacaaccaacaccaauucgccuuacguaacauagaaaaaggaaaauaugacaaggucaugccauacggccccuccggaaucaaacaaggcgacacccuauauuucccggccgucggauuucuaguccgcacugaguucacauacaacgacaguaacugccccauagccgaaugccaauauagcaaacccgaaaacugccgauuauccaugggaauccgacccaacucccacuacauccuccgcucagggcuccucaaauacaaccugagcgacgaagaaaacuccaaaaucgucuucaucgaaauauccgaccaacgccuaagcaucggcucacccagcaagauauaugacucccucggccaacccgucuucuaccaagcaucauucuccugggacaccaugauaaaauucggcgacguucaaacgguaaacccacucguaguuaacuggcgcgacaacacagucaucagccgccccggccaaucccaaugcccccgauuuaauaaaugccccgaagugugcugggaaggagucuacaacgacgccuuccugauagaccgcaucaacuggaucagcgcaggcgucuuccucgacuccaaccaaaccgccgaaaaccccgucuucacagucuucaaagacaacgaaguccuauaccgcgcacaacucgccucagaggacaccaacgcccagaaaaccaucaccaacugcuuccuucucaaaaacaaaauauggugcaucagccucgucgagaucuaugacacaggcgacaacgucauccgccccaaauuauucgccguaaaaaucccugaacaaugcacauaa

SEQ ID NO: 1033 - RNA, 1659 nt, Artificial Sequence
  derived and/or modified CDS sequence (opt11) from Hendra henipavirus__NP_047112__HsIgE(1-18)_G(70-604)
auggauuggacguggauacucuuucucguggccgcggccacgcgcgugcacucgcaaaacuacacucgaacaacagacaaccaagcacuaauaaaagagucacuccaguccguccaacaacaaaucaaagcacuaacagacaaaauaggaaccgagaucggucccaaagucucccuuaucgacacauccuccaccauuaccaucccagccaauauuggccuacuuggcuccaaaaucucccaaucaaccucaucaauaaacgaaaacgucaacgacaaaugcaaauucacccucccaccccuaaaaauccacgagugcaacaucuccugccccaacccacuucccuuccgcgaauaccgucccaucucccaaggcgucuccgaccuuguaggccucccuaaccaaaucugccuacagaaaaccacaagcaccauacucaaaccccgacuaaucucauacacccuaccuaucaacacacgagagggcgucugcaucaccgauccacuacuagcuguugacaacggcuuuuucgccuacucccaccucgagaaaaucggaucaugcacucgcggcauagccaaacaacgcaucaucggcgucggagaaguccucgaccgaggcgacaagguucccuccauguucaugaccaacguuuggacacccccuaaucccucaaccauccaccacugcuccucaaccuaccacgaagacuuuuacuacacccucugcgcagucucccacgucggcgaccccauacuaaacuccaccuccuggacagaaucccucucccucauccgucuggccguccgccccaaaucagacagcggagacuacaaccaaaaguacaucgcgauaaccaaagucgaacgcggcaaguacgacaaaguaaugcccuacggccccuccggcaucaaacaaggagacacucuauacuucccagcaguaggcuuccuaccccggacugaguuccaauacaacgacucaaacugccccaucauacacugcaaauacucaaaagcagaaaacugccggcucagcaugggggucaacucuaaaagccacuacauacuccgauccggauuacucaaauacaaccuaucccuaggcggcgacauaauccuccaguucauugaaaucgcugacaaccgccuuaccaucggcagcccaucaaaaauauacaacucucuaggacaacccgucuucuaccaagccuccuacuccugggacaccaugaucaaauuaggagacgucgacaccguagacccgcuccgcguacaguggcguaacaacucugucaucucccgccccggacagucucaaugcccccgcuucaaugucugccccgaaguaugcugggaaggcacguacaacgacgcauuccucaucgaccgccuuaacugggucucagcaggcguauaccucaacuccaaccaaacugccgaaaaccccguuuucgccguuuucaaggacaacgaaauccuauaccaagucccccucgccgaagacgacaccaacgcccagaaaacaaucacggacugcuuccuccuagaaaacguaaucuggugcaucagcuuagucgagaucuacgacacaggcgauucagucauacgccccaaacuauucgcuguuaagauccccgcccaaugcuccgaaaguuag

SEQ ID NO: 1034 - RNA, 1659 nt, Artificial Sequence
  derived and/or modified CDS sequence (opt11) from Hendra henipavirus__AEB21225__HsIgE(1-18)_G(70-604)
auggauuggacguggauacucuuucucguggccgcggccacgcgcgugcacucgcagaacuacacaaggaccaccgacaaccaagcccucauaaaggaaagccuacaauccguccaacaacaaaucaaagcacucaccgacaagaucggcaccgaaaucggacccaaggucucacuaaucgauaccucauccacaauaaccauaccagccaacaucgggcuacucggcucaaaaaucucccaguccacaagcuccauuaacgaaaacgucaacgacaaaugcaaguucacacucccgccccucaaaauccacgaaugcaacauauccugccccaacccccuccccuuccgugaauaccgcccgaucucucaaggugucucagaccucguaggccuccccaaccagaucugccuccaaaagacgaccucaacaauccucaaaccacgccuaaucuccuacacccuccccaucaacacccgagaaggagucugcaucaccgacccacuacucgccgucgauaacggcuucuuugccuacucacaccucgaaaagaucggauccugcacgcgcggcaucgcaaaacagcgcauaaucggcgucggcgaaguccucgaccgcggcgacaaagucccuagcauguucaugaccaacguauggaccccacccaaccccuccaccauccaccacugcagcaguacauaccacgaagacuucuacuacacccucugcgcugucucccacgugggagacccaauccucaauuccaccucauggaccgaaucgcucucccucauccggcuagccguucgccccaaauccgacuccggagacuacaaccagaaauacaucgcaauaacgaaagucgaaagaggcaaguacgacaaagucaugccguacggccccuccggaaucaaacaaggagacacccucuacuucccggccguaggauuccucccccgaaccgaauuucaauacaacgacucaaacugcccaauuauacacugcaaauacuccaaagccgaaaacugcagacuaucaaugggagucaacuccaaaucucacuacauacuccgcuccggacuccucaaauacaaccucucccugggcggcgacaucacacuccaauucaucgaaaucgccgacaaccgccucaccaucggcagccccucaaaaauauacaacucccucggacagcccgucuucuaccaggccuccuacucgugggauacaaugauaaaacucggcgacgucgacaccgucgacccccuucgaguccaauggcguaacaacucagucaucuccagacccggccaaagccaaugcccaagauucaacgucugccccgaaguaugcugggaaggaacauacaacgacgccuuccuuaucgaccgccucaacugggucucugccggcguauacuuaaacagcaaucaaaccgccgagaacccagucuucgcagucuuuaaagauaacgaaauccuauaccaagucccacucgcagaagacgacacaaacgcccagaaaacgaucacagacuguuuccuacuagaaaacgucaucuggugcaucagucucgucgaaauauacgacaccggcgacagcguaauacgccccaaacuuuucgccguaaagauccccgcucaauguucugaaucuuag

SEQ ID NO: 1035 - RNA, 1659 nt, Artificial Sequence
  derived and/or modified CDS sequence (opt11) from Hendra henipavirus__AEB21216__HsIgE(1-18)_G(70-604)
auggauuggacguggauacucuuucucguggccgcggccacgcgcgugcacucgcaaaacuacacacgcaccacagacaaccaagcccuaaucaaagaaagccuacaaucuguacaacagcaaaucaaagcacuaacagacaaaauuggcaccgaaauuggccccaaagucucccucaucgauacauccucaaccaucacaauacccgccaacaucggccuucucggcucuaaaauaucccaaagcaccuccucuaucaacgaaaacguaaacgacaagugcaaguucacacuaccaccccucaaaauccaugaaugcaauauaucaugccccaacccccuccccuuuagagaguaccgcccaaucucccaaggcgucuccgaccuggucgggcuaccaaaccaaaucugccuccagaaaacaaccuccaccauacuaaaaccccgccuuaucagcuacacccuacccaucaacacacgagagggcgucugcaucaccgacccccuccucgccgucgauaacggcuucuucgccuacagucaccucgaaaagaucggaagcugcaccagaggcaucgccaaacaacgcaucaucggcgucggagaaguucuugaccgcggcgauaaaguacccagcauguucaugacaaacgucuggacaccacccaacccaucaaccauccaccauugcuccucgacuuaccacgaagacuucuacuacacccuaugcgcgguuucccacguaggagaccccauccuuaacuccacgucuuggaccgaaucacucucccucauccgacuggccguacgccccaaaucugacuccggcgacuacaaccaaaaauauauugcaaucaacaaagucgaaagaggaaaauacgacaaagucaugccuuauggcccaagcggcaucaaacaaggagacacacucuacuuccccgccgucggcuuccucccccggaccgaguuccaauacaacgacuccaacugcccgauaauccacugcaaauacagcaaagcugaaaacugcagacuguccaugggagucaacuccaaaagccacuacauccuccgcuccgggcugcucaaauacaaccuaucccuugggggcgacaucauccuccaauucaucgaaauagcugacaacagacucacaauaggaucccccuccaaaaucuacaacucccucggucagccagucuucuaccaagccuccuacuccugggacacgaugaucaaacuaggugacgucgacacagucgacccccuacgaguccaauggcgaaacaacuccgucauaucccgccccggccaaagccaaugcccacguuucaacgucugccccgagguauguugggaaggcaccuacaacgacgcauuccucauagaccgacucaacugggucuccgccggcguauaccucaacagcaaccaaacugccgaaaaccccgucuuugccgucuuuaaggacaacgaaauccucuaccaagucccccucgccgaggaugacacuaacgcccagaaaaccauaaccgacuguuuucuucucgagaacgucaucuggugcaucagccucgucgagaucuacgacaccggcgacuccgucauacgacccaaacucuucgcagucaaaaucccagcacaaugcucugaguccuag

SEQ ID NO: 1036 - RNA, 1659 nt, Artificial Sequence
  derived and/or modified CDS sequence (opt11) from Hendra henipavirus__AEB21206__HsIgE(1-18)_G(70-604)
auggauuggacguggauacucuuucucguggccgcggccacgcgcgugcacucgcaaaacuacacccgaaccaccgacaaucaagcacucaucaaagaaucccuccaauccguccaacaacaaauaaaagcacuuacggacaagaucggaaccgaaauuggccccaaagucagccucaucgacacgagcuccacgauaaccauccccgccaacaucggccuccucggauccaaaauuucccaauccaccuccucaauaaacgaaaacguaaacgauaaauguaaauucacccuacccccauuaaaaauccacgaaugcaacauaucaugcccuaacccacuccccuuucgagaauaucgacccauaagccaaggugucagcgaccuaguaggccuccccaaccaaauaugccuccagaaaaccacauccaccauccuaaaaccacgccucauaucuuacacccuacccauaaacacucgagaaggggucugcauaaccgacccacuccucgccgucgacaacggguucuucgccuacucccaccuugagaaaaucggaagcugcacacgcggcauagcaaagcaaagaauaaucggcgucggagaaguacucgaccgcggcgacaaaguccccuccauguucaugaccaacgucuggaccccaccaaaccccuccaccauccaccacugcuccuccaccuaccacgaggacuucuacuacacacucugcgcaguaucacaugugggcgaccccauccucaacuccacauccuggaccgaaagccucucccucauccggcuugccguacguccuaaauccgacagcggaaacuacaaccaaaaguacaucgcaaucacaaaagucgagcggggcaaauacgacaaagucaugccauacggacccuccggcauaaaacaaggagacacccuauacuuccccgccgucggauuccuaccccgcaccgaguuccaauacaacgacuccaacugccccaucauacacuguaaauacucgaaagccgaaaacugccgccucuccaugggagucaacucuaaaucccacuacauccuccgcuccggccuccugaaauacaaccuaagccucgggggcgacaucauccuacaauucaucgaaaucgcggacaaccgacucacaauaggcucacccaguaaaauauacaacagccucggccaaccugucuucuaccaagccucauacuccugggacaccaugauaaaacucggcgacaucgacacagucgacccacugcgcguccaauggcgaaacaacuccguuaucucccguccuggacaaucucaaugcccccgauucaacguaugcccagaagucugcugggaaggaaccuacaacgacgccuuccuuauugaccgacucaacugggucucugcgggcguauaccuuaacuccaaccagaccgccgaaaaccccguauucgcagucuucaaagauaacgaaauccuauaccaagucccccucgccgaagaugacaccaacgcccagaaaacaaucaccgacugcuuccuccucgaaaacguaaucuggugcaucucccucguugaaauauacgacaccggcgacuccguaauacgacccaaacuauucgcugucaaaauccccgcacaaugcucagaauccuaa

SEQ ID NO: 1037 - RNA, 1659 nt, Artificial Sequence
  derived and/or modified CDS sequence (opt11) from Hendra henipavirus__AEQ38052__HsIgE(1-18)_G(70-604)
auggauuggacguggauacucuuucucguggccgcggccacgcgcgugcacucgcaaaacuacacacguaccacagacaaccaagcccucauuaaagaauccuuacaauccguccaacaacaaauaaaagcccucaccgacaaaauaggcacugaaaucggccccaaaguaucccucauugacaccagcuccaccaucaccaucccagccaacaucggccuacucgguucgaaaaucucccaaucgacuucauccauaaacgaaaacguaaacgauaagugcaaguucacgcuacccccacuaaaaauacacgaaugcaacauauccugcccaaacccccucccuuuccgcgaauacaggccaaucucccaaggcgucuccgaccuaguaggccuaccuaaccaaauuugccuccaaaagacaaccuccacgauccucaaaccacgccuaauauccuacacccuucccaucaacacccgcgaaggaguaugcaucacagacccacuccucgccgucgacaacggcuucuuugcauauucacaccucgagaaaaucggcucuugcacacgcggcaucgcaaaacaacgcaucaucggcgucggugaaguccuagacagaggcgacaaaguacccuccauguucaugaccaacguauggaccccgccaaaccccucgaccauacaccacuguuccuccaccuaccacgaagacuucuacuacacacucugcgcagucucccacguaggggaccccauccucaacucgacauccuggaccgaaucacuuucccuaauccgccuagcaguacggcccaaaucagacuccggcgacuacaaccaaaaauacauaacaauuaccaaagucgaacguggaaaauacgauaaaguaaugcccuacggccccuccggcauaaaacaaggcgacacacucuacuuccccgcagucggauuccucccccgaaccgaguuccaauacaacgacucaaacugccccaucauacacuguaaauacucaaaagcagaaaacugccgccucuccaugggcguaaacucaaaaucccacuacauucuccgcagcggacuacugaaguacaaccucucacucggcggcgacauuauucuucaauucauagaaaucgccgacaaccgcuuaacaauaggcucacccucaaagaucuacaauucccuuggccaacccgucuucuaccaagcauccuacuccugggacacaaugaucaaguuaggcgaugucgacacagucgacccccuccgugugcaauggcgaaacaauuccgucaucucacgcccaggccaaucccaaugcccccguuucaacgucugccccgaggucugcugggaaggcacauacaacgaugccuuccucaucgaccgucucaacugggucucagccggagucuaccuaaacuccaaccaaacugcagaaaaccccgucuucgccgucuucaaggacaacgaaauccucuaccaaguaccacuagccgaagacgacaccaacgcucagaaaaccaucacagacugcuuucugcuagaaaacgucauauggugcauuucccucgucgaaauauacgauaccggagacuccgucaucagacccaaacuguuugcagucaaaaucccagcacaaugcuccgaauccuaa

SEQ ID NO: 1038 - RNA, 1659 nt, Artificial Sequence
  derived and/or modified CDS sequence (opt11) from Hendra henipavirus__AEQ38115__HsIgE(1-18)_G(70-604)
auggauuggacguggauacucuuucucguggccgcggccacgcgcgugcacucgcaaaacuacacccgcacaacugacaaccaagcacucaucaaagaaucacuccaauccguccaacaacaaauaaaagcacucaccgacaaaauagguacagaaaucggccccaaagucucacuaaucgacacaucaagcaccaucacgaucccagccaacaucggccuacucggauccaaaauaucccaaucuacaaguuccaucaacgaaaacguaaacgacaagugcaaauucacccuaccaccccugaaaauacaugaaugcaacaucucaugccccaacccccuccccuuccgagaauaccgccccauuucccaaggaguauccgaccucgugggacuacccaaccaaaucugccugcagaaaacaaccuccacaauccuaaaaccccgacucauuucuuacacgcuccccaucaacacgcgagaaggcguaugcauaaccgacccccuauuagcaguugacaacggcuucuucgccuacucccaccuagagaaaaucggcucauguacccgcggcaucgccaagcaacgcauaaucggcguaggcgaaguccuggaccgaggagacaaggucccaagcauguucaugaccaacguuuggaccccacccaaccccuccaccauccaccacugcagcuccaccuaccacgaagacuucuacuacacgcuuugugccgucucucacgucggagaccccauacuuaacuccacauccuggaccgaaucgcugagccugauccgccucgcgguccgacccaaauccgacaacggcgauuacaaccaaaaauacaucgccaucaccaaaguagaacgaggcaaguacgacaaagucaugcccuacggccccuccggcaucaagcaaggcgacacccuauauuucccagccgucggauuccucccccgcacagaguuccaguacaacgacuccaacugccccaucauucacugcaaguacuccaaagcugaaaacugccggcucucaaugggcgucaacuccaaaucgcacuacauacuacguucuggccuccucaaauacaaccucagccuaggaggagacauaauacuccaauucaucgaaaucgcagacaaccgccucaccaucgggucccccucaaaaauauauaacucccucggccagccugucuucuaccaagccuccuacuccugggacaccaugaucaagcucggagacguugacaccguagacccccuccgcguacaguggcgcaacaacuccgucauaagucgccccggacaaucccaaugccccagauucaacgucugcccagaagucugcugggaaggcacguacaacgacgcauuccuuaucgaucgccuaaauugggucuccgcaggagucuaccucaacucuaaccaaaccgcagaaaaccccgucuucgccgucuucaaagacaacgaaauccucuaccaagucccccucgcugaagacgacaccaacgcacagaaaacuaucaccgauugcuuccuacucgaaaacgucaucuggugcaucucacucguagaaauauacgacaccggcgacuccgucauucgccccaaacucuucgcagucaaaaucccagcccaaugcagcgaaucuuag

SEQ ID NO: 1039 - RNA, 1659 nt, Artificial Sequence
  derived and/or modified CDS sequence (opt11) from Hendra henipavirus__AEQ38108__HsIgE(1-18)_G(70-604)
auggauuggacguggauacucuuucucguggccgcggccacgcgcgugcacucgcaaaacuacacacgaacaaccgacaaccaagcccucauuaaggaaucccuccaaucaguccaacaacaaaucaaagcgcuuacugacaagaucggcaccgaaauaggccccaaagucucccuaauugacaccucaucuacaauaaccauccccgccaacaucggccuccuagggucaaaaaucucucaauccacauccagcauaaacgagaacgucaacgacaagugcaaguucacccuaccaccccucaaaauacacgagugcaacauaagcugccccaacccccuccccuuccgagaguaccgccccauaucacagggagucucagaccucguaggacuacccaaccaaaucugccuucagaaaaccacuuccacuauccuuaaaccccgccucaucuccuauacccuaccuaucaacacccgcgaaggcgucugcaucacggacccccuacuagcagucgacaacggcuucuucgcauacucccaucuugagaaaauaggaagcuguacccgaggcauagccaaacaacgcaucaucggcguuggcgaaguccuagaccgcggcgacaaaguccccucuauguucaugaccaacgucuggacucccccaaaccccucaaccauccaccacugcuccucaaccuaccacgaagacuucuacuacacccuaugcgcagucucucacgucggggacccuauacucaacuccacuucauggaccgaaagccucucccuaauccgccuagccgucaggcccaaauccgacucaggcgacuacaaccaaaaauacaucaccaucaccaaggucgaacgaggcaaauacgacaaagucaugcccuacgggcccuccggcauaaaacaaggcaacacccuauauuuuccagccguuggcuuccuuccccgaacugaguuccaauacaaugacuccaacugcccaauaauccacugcaaauacuccaaagcagaaaacugccgacuauccaugggagucaacucgaaaucgcacuacauccuccgcucuggccucuuaaaauacaaccucucccucggcggagacaucauccuccaguucaucgaaaucgccgacaaccgucucaccaucggauccccauccaaaaucuacaauucccucggccaacccgucuuuuaucaggcauccuauuccugggacaccaugaucaaacuuggugacgucgacaccgucgacccccuacgcguacaauggcggaacaacucagucauaucacgcccaggccaaucccagugcccucgcuucaacgucugcccagaaguaugcugggaaggaaccuacaacgacgccuuccucauagaucgccucaacugggucuccgccggcgucuacuuaaacagcaaccaaacagccgaaaacccaguuuucgccgucuucaaagacaacgaaauccuguaccaaguuccacuagccgaagaugacacaaacgcucagaaaaccauuacagacugcuuucuccucgaaaacgugauauggugcauaucccucgucgaaaucuacgacacgggagacuccgucauccguccaaaacuguucgccgucaaaaucccagcccaauguuccgaauccuag

SEQ ID NO: 1040 - RNA, 1659 nt, Artificial Sequence
  derived and/or modified CDS sequence (opt11) from Hendra henipavirus__AAV80426__HsIgE(1-18)_G(70-604)
auggauuggacguggauacucuuucucguggccgcggccacgcgcgugcacucgcaaaauuacacccgcaccacagacaaccaagcccucauaaaagaaucccuccaaucaguccaacaacagaucaaagcccugaccgacaaaauaggcacagaaaucggacccaaagucucccuaaucgacaccucauccaccaucacuaucccggcaaacaucggccuccucggcuccaaaaucagccaaugcaccuccucaauaaacgaaaacgucaaugacaaauguaaauuuacccugccgcccuuaaaaauccacgagugcaacaucucaugccccaacccccuccccuuccgcgaauacagacccaucucccaaggcgucucggaccucgucggccuccccaaccaaaucugccuccagaaaaccaccucgaccauucucaagccccgccuaaucuccuacacacucccaauaaauacucgcgagggagucugcaucaccgacccacuacuagccgucgacaacggcuucuuugccuacucccaccuagagaaaaucggcaguugcacccgcggcaucgccaaacaacguauaaucggugucggugaaguacucgacagaggcgacaaaguccccagcauguucaugaccaacgucuggacgcccccaaaccccucaaccauccaccacugcucaucaaccuaccacgaagacuuuuacuacacccucugcgcugucucucacgucggagacccaauccucaacucaacaucauggacagaaagccucagccuaauacgccuagccguccggcccaaauccgacucaggcgacuacaaccaaaaauacauugccauaaccaaagucgaacggggaaaauacgacaaaguuaugcccuauggccccucggggaucaaacaaggagacacccucuacuuccccgcagucggcuuccucccccgcaccgaguuccaauacaacgacuccaacugccccaucauccacugcaaauacagcaaggccgaaaacugccgccuaagcaugggcguaaacuccaagucacacuacauccugcgcucaggacuacugaaauacaaccucucccucggcggagacaucauacuccaauucaucgaaaucgccgacaaccgccuaaccauaggcucccccucaaaaaucuacaacucccuaggccaacccgucuucuaccaagccuccuacucuugggacaccaugauaaaacuaggagacgucgacacugucgacccccuacgcguacaauggcguaacaacucagucaucucccgcccgggccaaagccaaugcccacgcuucaacgucugccccgaaguuugcugggaaggcuccuacaacgacgccuuccuaauagaccgucucaacugggucagcgcaggagucuaccucaacuccaaccaaaccgccgaaaacccugucuuugccguuuucaaggacaacgaaauacucuaccaggucccucucgcagaggacgacaccaacgcacagaaaaccaucaccgacugcuuccugcucgaaaacguaaucuggugcaucucccuugucgaaauauacgacaccggcgacuccgucauacguccaaaacuauucgccguaaaaaucccagcccaaugcuccgaauccuaa

SEQ ID NO: 1041 - protein, 537 aa, Artificial Sequence
  derived and/or modified protein sequence (wt) from Nipah henipavirus__AAK50553__H1N1-HA(1-17)_F(27-546)
MKAILVVLLYTFATANAILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1042 - protein, 537 aa, Artificial Sequence
  derived and/or modified protein sequence (wt) from Nipah henipavirus__AEZ01388__H1N1-HA(1-17)_F(27-546)
MKAILVVLLYTFATANAILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1043 - protein, 537 aa, Artificial Sequence
  derived and/or modified protein sequence (wt) from Nipah henipavirus__AAY43915__H1N1-HA(1-17)_F(27-546)
MKAILVVLLYTFATANAILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYSSDLLFVFGPNLQDPVSNSMTIQAISQAFGGNYETLLRTLGYATEGFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1044 - protein, 537 aa, Artificial Sequence
  derived and/or modified protein sequence (wt) from Nipah henipavirus__CAF25496__H1N1-HA(1-17)_F(27-546)
MKAILVVLLYTFATANAILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYAIEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1045 - protein, 537 aa, Artificial Sequence
  derived and/or modified protein sequence (wt) from Nipah henipavirus__AAM13405__H1N1-HA(1-17)_F(27-546)
MKAILVVLLYTFATANAILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPTTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1046 - protein, 537 aa, Artificial Sequence
  derived and/or modified protein sequence (wt) from Nipah henipavirus__CBM41033__H1N1-HA(1-17)_F(27-546)
MKAILVVLLYTFATANAILHYEKLSKIGLVKGVTRKYKIKSNPLTKDIVIKMIANVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQKSSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1047 - protein, 537 aa, Artificial Sequence; identical to SEQ ID NO: 1042
  derived and/or modified protein sequence (wt) from Nipah henipavirus__AEZ01396__H1N1-HA(1-17)_F(27-546)

SEQ ID NO: 1048 - protein, 537 aa, Artificial Sequence
  derived and/or modified protein sequence (wt) from Hendra henipavirus__NP_047111__H1N1-HA(1-17)_F(27-546)
MKAILVVLLYTFATANAILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 1049 - protein, 537 aa, Artificial Sequence
  derived and/or modified protein sequence (wt) from Hendra henipavirus__AEB21233__H1N1-HA(1-17)_F(27-546)
MKAILVVLLYTFATANAILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 1050 - protein, 537 aa, Artificial Sequence
  derived and/or modified protein sequence (wt) from Hendra henipavirus__AEQ38114__H1N1-HA(1-17)_F(26-546)
MKAILVVLLYTFATANAILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFIIVEKKRGNYSRLDDRQVRPVSNGDLYYIGT

SEQ ID NO: 1051 - protein, 537 aa, Artificial Sequence
  derived and/or modified protein sequence (wt) from Hendra henipavirus__AAB39505__H1N1-HA(1-17)_F(27-546)
MKAILVVLLYTFATANAILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLLICSCFGPNLQDPVSNSMTIQAISQAFGGNYETLLRTLGYATEDFDDLLESDSITGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSREQTLLMIDNTTCTTVVLGNIIISLPKYLGSIKLQVLRALLLGHQSIQTKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 1052 - protein, 549 aa, Artificial Sequence
  derived and/or modified protein sequence (wt) from Nipah henipavirus__AAK50554__H1N1-HA(1-17)_G(70-602)
MKAILVVLLYTFATANAQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 1053 - protein, 549 aa, Artificial Sequence
  derived and/or modified protein sequence (wt) from Nipah henipavirus__AEZ01389__H1N1-HA(1-17)_G(70-602)
MKAILVVLLYTFATANAQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPILNSTYWSGSLMMTRLAVKPKNNGESYNQHQFALRNIEKGKYDKVMPYGPSGIKQGDTLYFPAVGFLVRTEFKYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 1054 - protein, 549 aa, Artificial Sequence
  derived and/or modified protein sequence (wt) from Nipah henipavirus__ACT32615__H1N1-HA(1-17)_G(70-602)
MKAILVVLLYTFATANAQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPVLNSTYWSGSLMMTRLAVKPKNNGESYNQHQFALRNIEKGKYDKVMPYGPSGIKQGDTLYFPAVGFLVRTEFKYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 1055 - protein, 549 aa, Artificial Sequence
  derived and/or modified protein sequence (wt) from Nipah henipavirus__CAF25497__H1N1-HA(1-17)_G(70-602)
MKAILVVLLYTFATANAQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWAPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 1056 - protein, 549 aa, Artificial Sequence
  derived and/or modified protein sequence (wt) from Nipah henipavirus__CBM41034__H1N1-HA(1-17)_G(70-602)
MKAILVVLLYTFATANAQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPDNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKIVFIEISDQRLSIGSPSKVYDSLGQPVFYQASFSWDTMIKFGDVQTVNPLVVNWRDNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 1057 - protein, 549 aa, Artificial Sequence
  derived and/or modified protein sequence (wt) from Nipah henipavirus__AAX51853__H1N1-HA(1-17)_G(70-602)
MKAILVVLLYTFATANAQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQKIIGVGEVLDRGDEVPSLFMTNVWTPPNPNTVYHCSAVYNNEFYYVLCAVSTVGDPILNSTYWSGSLMMTRLAVKPKSNDGGYNQHQLALRSIEKGRYDKVMPYGPSGIKQGDTLYFPAVGFLVRTEFKYNDSNCPITKCQYSKPENCRLSMGIRPNSHYVLRSGLLKYNLSDGENPKIVFIEISDQRLSIGSPSKIYDSLGQPVFYQASFSWDTMIKFGDVQTVNPLVVSWRDNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 1058 - protein, 549 aa, Artificial Sequence
  derived and/or modified protein sequence (wt) from Nipah henipavirus__AEZ01397__H1N1-HA(1-17)_G(70-602)
MKAILVVLLYTFATANAQNYTRSTDNQAMIKDALQSIQQQIKGLADKIGTEIGPKVSLIDTSSTITIPANIGLLGSKISQSTASINENVNEKCKFTLPPLKIHECNISCPNPLPFREYKPQTEGVSNLVGLPNNICLQKTSNQILKPKLISYTLPVVGQSGTCITDPLLAMDEGYFAYSHLEKIGSCSRGVSKQRIIGVGEVLDRGDEVPSLFMTNVWTPSNPNTVYHCSAVYNNEFYYVLCAVSVVGDPILNSTYWSGSLMMTRLAVKPKNNGESYNQHQFALRNIEKGKYDKVMPYGPSGIKQGDTLYFPAVGFLVRTEFTYNDSNCPIAECQYSKPENCRLSMGIRPNSHYILRSGLLKYNLSDEENSKIVFIEISDQRLSIGSPSKIYDSLGQPVFYQASFSWDTMIKFGDVQTVNPLVVNWRDNTVISRPGQSQCPRFNKCPEVCWEGVYNDAFLIDRINWISAGVFLDSNQTAENPVFTVFKDNEVLYRAQLASEDTNAQKTITNCFLLKNKIWCISLVEIYDTGDNVIRPKLFAVKIPEQCT

SEQ ID NO: 1059 - protein, 551 aa, Artificial Sequence
  derived and/or modified protein sequence (wt) from Hendra henipavirus__NP_047112__H1N1-HA(1-17)_G(70-604)
MKAILVVLLYTFATANAQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 1060 - protein, 551 aa, Artificial Sequence
  derived and/or modified protein sequence (wt) from Hendra henipavirus__AEB21225__H1N1-HA(1-17)_G(70-604)
MKAILVVLLYTFATANAQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDITLQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 1061 - protein, 551 aa, Artificial Sequence
  derived and/or modified protein sequence (wt) from Hendra henipavirus__AEB21216__H1N1-HA(1-17)_G(70-604)
MKAILVVLLYTFATANAQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAINKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 1062 - protein, 551 aa, Artificial Sequence
  derived and/or modified protein sequence (wt) from Hendra henipavirus__AEB21206__H1N1-HA(1-17)_G(70-604)
MKAILVVLLYTFATANAQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGNYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDIDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 1063 - protein, 551 aa, Artificial Sequence
  derived and/or modified protein sequence (wt) from Hendra henipavirus__AEQ38052__H1N1-HA(1-17)_G(70-604)
MKAILVVLLYTFATANAQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYITITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 1064 - protein, 551 aa, Artificial Sequence
  derived and/or modified protein sequence (wt) from Hendra henipavirus__AEQ38115__H1N1-HA(1-17)_G(70-604)
MKAILVVLLYTFATANAQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDNGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 1065 - protein, 551 aa, Artificial Sequence
  derived and/or modified protein sequence (wt) from Hendra henipavirus__AEQ38108__H1N1-HA(1-17)_G(70-604)
MKAILVVLLYTFATANAQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYITITKVERGKYDKVMPYGPSGIKQGNTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 1066 - protein, 551 aa, Artificial Sequence
  derived and/or modified protein sequence (wt) from Hendra henipavirus__AAV80426__H1N1-HA(1-17)_G(70-604)
MKAILVVLLYTFATANAQNYTRTTDNQALIKESLQSVQQQIKALTDKIGTEIGPKVSLIDTSSTITIPANIGLLGSKISQCTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGSYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 1067 - RNA, 1614 nt, Artificial Sequence
  derived and/or modified CDS sequence (wt) from Nipah henipavirus__AAK50553__H1N1-HA(1-17)_F(27-546)
augaaggcaauacuaguaguucugcuauauacauuugcaaccgcaaaugcaauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuuaguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuaugaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 1068 - RNA, 1614 nt, Artificial Sequence
  derived and/or modified CDS sequence (wt) from Nipah henipavirus__AEZ01388__H1N1-HA(1-17)_F(27-546)
augaaggcaauacuaguaguucugcuauauacauuugcaaccgcaaaugcaauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacuaacugcuuugcaggauuacauuaauacuaacuugguaccgacaauugacaagauaagcugcaaacagacggaacucucauuagaucuagcacuaucaaaguaccucucugauuugcuuuuuguauuuggucccaaccuucaagacccaguuucuaauucaaugacuauacaggcuauaucucaggcauucgguggaaauuaugaaacacugcuaagaacguuggguuacgcuacagaagacuuugaugaucuucuagaaagugacagcauaacgggucaaauuaucuacguugauuuaaguggcuacuacauaauugucaggguuuauuuuccuauccugacugaaauccaacaggccuauauccaagaauuguugcccgugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcugaugauugauaacaccaccuguccuacagcuguacucgguaaugugaucaucagcuugggaaaauaucuugggucaguaaauuauaacucugaaggcauugcuauugguccuccugucuuuacugauaaaguugacauaucaagucaaauaucuagcaugaaucaguccuuacagcaaucuaaggacuauaucaaagaagcucaacgacuccuugauacuguuaacccgucauuaauaagcauguuaucuaugaucauacuguauguacuaucaauugcaucauuguguauaggguugauuacauuuaucaguuuuaucauuguugagaaaaaaagaaauaccuauagcagauuagaggacaggagggucagaccuacaagcaguggggaucucuauuacauugggacguag

SEQ ID NO: 1069 - RNA, 1614 nt, Artificial Sequence
  derived and/or modified CDS sequence (wt) from Nipah henipavirus__AAY43915__H1N1-HA(1-17)_F(27-546)
augaaggcaauacuaguaguucugcuauauacauuugcaaccgcaaaugcaauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguacuccucugauuugcuuuuuguauuuggucccaaccuucaagacccaguuucuaauucaaugacuauacaggcuauaucucaggcauucgguggaaauuaugaaacacugcuaagaacguuggguuacgcuacagaaggcuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcuaaugauugauaacaccaccuguccuacagcuguacucgguaaugugaucaucagcuuggggaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 1070 - RNA, 1614 nt, Artificial Sequence
  derived and/or modified CDS sequence (wt) from Nipah henipavirus__CAF25496__H1N1-HA(1-17)_F(27-546)
augaaggcaauacuaguaguucugcuauauacauuugcaaccgcaaaugcaauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcuuuacaggauuacauuaauacuaauuuaguaccgacaauugacaaaauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuauagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauuaguaaggaauacauuaauaucaaauauagagauuggauuuugccuaauuacaaagaggagcgugaucugcaaccaagauuaugccacaccuaugaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 1071 - RNA, 1614 nt, Artificial Sequence
  derived and/or modified CDS sequence (wt) from Nipah henipavirus__AAM13405__H1N1-HA(1-17)_F(27-546)
augaaggcaauacuaguaguucugcuauauacauuugcaaccgcaaaugcaauucuacauuaugagaaauugaguaaaauuggacuugucaaaggaguaacaagaaaauacaagauuaaaagcaauccucucacaaaagacauuguuauaaaaaugauuccgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugcuauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuuaguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuacgaccaacaacaugagagaauguuuaacgggaucgacugagaaguguccucgagagcugguuguuucaucacauguucccagauuugcacuaucuaacgggguucuguuugccaauugcauaaguguuacaugucagugucaaacaacaggcagggcaaucucacaaucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagauauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuagaggauaggagagucagaccuacaagcaguggggaucucuacuacauugggacauag

SEQ ID NO: 1072 - RNA, 1614 nt, Artificial Sequence
  derived and/or modified CDS sequence (wt) from Nipah henipavirus__CBM41033__H1N1-HA(1-17)_F(27-546)
augaaggcaauacuaguaguucugcuauauacauuugcaaccgcaaaugcaauucuacauuaugagaaauugaguaaaauuggacuugucaaaggaguaacaagaaaauacaagauuaaaagcaauccucucacaaaagacauuguuauaaaaaugauugcgaaugugucgaacaugucucagugcacagggagugucauggaaaauuauaaaacacgauuaaacgguaucuuaacaccuauaaagggagcguuagagaucuacaaaaacaacacucaugaccuugucggugaugugagauuagccggaguuauaauggcaggaguugccauugggauugcaaccgcagcucaaaucacugcagguguagcacuauaugaggcaaugaagaaugcugacaacaucaacaaacucaaaagcagcauugaaucaacuaaugaagcugucguuaaacuucaagagacugcagaaaagacagucuaugugcugacugcucuacaggauuacauuaauacuaauuugguaccgacaauugacaagauaagcugcaaacagacagaacucucacuagaucuggcauuaucaaaguaccucucugauuugcuuuuuguauuuggccccaaccuucaagacccaguuucuaauucaaugacuauacaggcuauaucucaggcauucgguggaaauuaugaaacacugcuaagaacauuggguuacgcuacagaagacuuugaugaucuucuagaaagugacagcauaacaggucaaaucaucuauguugaucuaaguagcuacuauauaauugucaggguuuauuuuccuauucugacugaaauucaacaggccuauauccaagaguuguuaccagugagcuucaacaaugauaauucagaauggaucaguauugucccaaauuucauauugguaaggaauacauuaauaucaaauauagagauuggauuuugccuaauuacaaagaggagcgugaucugcaaccaagauuaugccacaccuaugaccaacaacaugagagaauguuugacgggaucgacugagaaguguccucgagagcugguuguuucaucacauguucccagauuugcacuaucuaacggaguucuguuugccaauugcauaaguguuacaugccagugucaaacaacaggcagggcaaucucacagucaggagaacaaacucugcugaugauugacaacaccaccuguccuacagccguacucgguaaugugauuaucagcuuagggaaauaucuggggucaguaaauuauaauucugaaggcauugcuaucgguccuccagucuuuacagauaaaguugauauaucaagucagaaauccagcaugaaucaguccuuacaacagucuaaggacuauaucaaagaggcucaacgacuccuugauacuguuaauccaucauuaauaagcauguugucuaugaucauacuguauguauuaucgaucgcaucguuguguauaggguugauuacauuuaucaguuuuaucauuguugagaaaaagagaaacaccuacagcagauuggaggauaggagagucagaccuacaagcaguggggaucucuacuacauugggacauag

SEQ ID NO: 1073 - RNA, 1614 nt, Artificial Sequence
  derived and/or modified CDS sequence (wt) from Nipah henipavirus__AEZ01396__H1N1-HA(1-17)_F(27-546)
augaaggcaauacuaguaguucugcuauauacauuugcaaccgcaaaugcaauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaacuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguaccucucugauuugcuuuuuguauuuggucccaaccuucaagacccaguuucuaauucaaugacuauacaggcuauaucucaggcauucgguggaaauuaugaaacacugcuaagaacguuggguuacgcuacagaagacuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcuggugguuucaucacacguucccagauuugcacuaucuaacgggguuuuguuugcuaauugcauaagcgucacaugccagugucaaacaacagguagggcaaucucacagucaggagaacaaacucugcugaugauugauaacaccaccuguccuacagccguacucgguaaugugaucaucagcuugggaaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 1074 - RNA, 1614 nt, Artificial Sequence
  derived and/or modified CDS sequence (wt) from Hendra henipavirus__NP_047111__H1N1-HA(1-17)_F(27-546)
augaaggcaauacuaguaguucugcuauauacauuugcaaccgcaaaugcaauacuacauuaugagaaacuuaguaagauagggcugguuaaagguauuacaagaaaguacaagauuaagaguaacccuuugaccaaggauauugugaucaaaaugaucccuaaugucucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcagguguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagagcucgcauuagacuuggcguugucuaaguaucugucugaucugcucuuuguuuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauagcaggccagauagucuauguagaucucaguagcuauuacauaauaguaaggguguauuuucccauacuaacagagauccaacaggcuuaugugcaggaguugcuuccagugaguuuuaauaacgauaauucagaauggaucagcauugucccgaauuucgugcugauuaggaacacgcugauuucaaauauagaagucaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcagcacugugcauuggucugaucacuuucauaagcuuuguaauaguugagaaaaagagagggaauuacagcaggcuagaugauaggcaagugcgaccggucaguaauggugaucuguauuauauuggaacauaa

SEQ ID NO: 1075 - RNA, 1614 nt, Artificial Sequence
  derived and/or modified CDS sequence (wt) from Hendra henipavirus__AEB21233__H1N1-HA(1-17)_F(27-546)
augaaggcaauacuaguaguucugcuauauacauuugcaaccgcaaaugcaauacuacauuaugagaaacuuaguaagauagggcugguuaaagguauuacaagaaaguacaagauuaagaguaacccuuugaccaaggauauuguaaucaaaaugaucccuaauguuucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcaggcguggugauggcagggauugcaaucgggauagcuacugcugcacaaaucacagcagguguugcguuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagaacucgcauuagacuuggcguugucuaaguaucugucugaucugcucuuuguuuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuuccuauacuaacagagauccaacaggcuuaugugcaggaguugcuuccagugaguuuuaauaacgauaauucagaauggaucagcauugucccgaauuucgugcugauuaggaacacgcugauuucaaauauagaaguuaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauucgcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcggcacugugcauuggucugaucacuuucauaagcuuuguaauaguugagaaaaagagagggaauuacagcaggcuagaugauaggcaggugcgaccggucaguaauggugaucuguauuauauuggaacauaa

SEQ ID NO: 1076 - RNA, 1617 nt, Artificial Sequence
  derived and/or modified CDS sequence (wt) from Hendra henipavirus__AEQ38114__H1N1-HA(1-17)_F(26-546)
augaaggcaauacuaguaguucugcuauauacauuugcaaccgcaaaugcagggauacuacauuaugagaaacuuaguaagauagggcugguuaaagguauuacaagaaaguacaagauuaagaguaacccuuugaccaaggauauuguaaucaaaaugaucccuaauguuucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcaggcguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagaacucgcauuagacuuggcguugucuaaguaucugucugaucugcucuuuguuuucggacccaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuuccuauacuaacagagauccaacaggcuuaugugcaggaguugcuuccagugaguuuuaauaacgauaauucagaauggaucagcauugucccgaauuucgugcugauuaggaacacgcugauuucaaauauagaaguuaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaaucaggggaacagacacuacugaugauugacaauacuaccugcacaacaguuguucuaggaaacauaaucauaagccuuggaaaauauuugggaucaauaaauuacaauucugagagcauugcuguugggccaccagucuauacagacaaaguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcggcacugugcauuggucugaucacuuucauaagcuuuauaauaguugagaaaaagagagggaauuacagcaggcuagaugauaggcaggugcgaccggucaguaauggugaucuguauuauauuggaacauaa

SEQ ID NO: 1077 - RNA, 1614 nt, Artificial Sequence
  derived and/or modified CDS sequence (wt) from Hendra henipavirus__AAB39505__H1N1-HA(1-17)_F(27-546)
augaaggcaauacuaguaguucugcuauauacauuugcaaccgcaaaugcaauacuacauuaugagaaacuuaguaagauagggcugguuaaagguauuacaagaaaguacaagauuaagaguaacccuuugaccaaggauauugugaucaaaaugaucccuaaugucucgaaugucucaaagugcaccgggacuguuauggagaauuacaaaagcagacucacagggauucucucaccaaucaaaggcgccaucgaacuguacaauaauaacacgcaugaccuaguuggugaugucaagcuugcagguguggugauggcagggauugcaaucgggauagcuacugcugcacaaaucacagcagguguugccuuauaugaggcaaugaagaacgcagacaauaucaauaaacucaagagcagcauagagucuacaaaugaggcuguugucaaauuacaggaaacagcugagaaaacagucuacguccuuacugcucuucaagauuacaucaacacuaaccuuguuccuacaauagaucaaauuagcugcaagcaaacagagcucgcauuagacuuggcguugucuaaguaucugcugaucugcucuuguuucggaccuaacuuacaggauccagucucuaauuccaugacuauccaagcaauaucucaagcauuugggggcaauuacgaaaccuuacugagaacgcuugguuacgcgaccgaggacuucgacgaccuuuuagaaagugauagcauaacaggccagauagucuauguagaucucaguagcuauuacauaauaguaaggguguauuuucccauacuaacagagauccaacaggcuuaugugcaggaguugcuuccagugaguuuuaauaacgauaauucagaauggaucagcauugucccgaauuucgugcugauuaggaacacgcugauuucaaauauagaagucaaguacugcuuaaucaccaagaaaagugugauuuguaaucaggacuaugcuacacccaugacggcuagcgugagagaaugcuugacaggauccacagauaagugcccaagggaguuaguagucucaucccauguuccaagauuugcccucucaggaggagucuuguuugcaaauuguauaagugugacaugucagugucagacuacugggagggcaauaucucaauccagggaacagacacuacugaugauugacaauacuaccugcacaacaguuguucuaggaaacauaaucauaagccuuccaaaauauuugggaucaauaaaguuacaaguucugagagcauugcuguugggccaccagucuauacagacaaagguugauaucucaagucagauaucuaguaugaaucaaucacuacaacaaucuaaggauuacauuaaagaagcucaaaagaucuuggacacugugaauccgucguugauaaguaugcuaucaaugaucauccuuuauguuuuguccauugcagcacugugcauuggucugaucacuuucauaagcuuuguaauaguugagaaaaagagagggaauuacagcaggcuagaugauaggcaagugcgaccggucaguaauggugaucuguauuauauuggaacauaa

SEQ ID NO: 1078 - RNA, 1650 nt, Artificial Sequence
  derived and/or modified CDS sequence (wt) from Nipah henipavirus__AAK50554__H1N1-HA(1-17)_G(70-602)
augaaggcaauacuaguaguucugcuauauacauuugcaaccgcaaaugcacaaaauuacacaagaucaacagacaaucaggccgugaucaaagaugcguugcaggguauccaacagcagaucaaagggcuugcugacaaaaucggcacagagauagggcccaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacucccuuuuagagaguauaggccacagacagaaggggugagcaaucuaguaggauuaccuaauaauauuugccugcaaaagacaucuaaucagauauugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucuggaccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaguuguauucauugaaauaucugaucaaagauuaucuauuggaucuccuagcaaaaucuaugauucuuugggucaaccuguuuucuaccaagcgucauuuucaugggauacuaugauuaaauuuggagauguucuaacagucaacccucugguugucaauuggcguaauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuuuacuguauucaaagauaaugaaauacuuuauagggcacaacuggcuucugaggacaccaaugcacaaaaaacaauaacuaauuguuuucucuugaagaauaagauuuggugcauaucauugguugagauauaugacacaggagacaaugucauaagacccaaacuauucgcgguuaagauaccagagcaauguacauaa

SEQ ID NO: 1079 - RNA, 1650 nt, Artificial Sequence
  derived and/or modified CDS sequence (wt) from Nipah henipavirus__AEZ01389__H1N1-HA(1-17)_G(70-602)
augaaggcaauacuaguaguucugcuauauacauuugcaaccgcaaaugcacagaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuaucccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguguacaacaaugaauucuauuaugugcuuugugcagugucaguuguuggagacccuauucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguagguuuuuuggucaggacagaguucaaauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucaaccuguuuucuaccaagcgucuuuuucaugggacacuaugauuaaauuuggagauguccaaacaguuaacccuuuaguuguaaauuggcgugacaacacgguaaucucaagaccuggacaaucacaaugcccuagauucaacaagugcccagagguuugcugggaagggguuuauaaugaugccuuccugauugauagaaucaauuggauaagugcggguguauuccuugacagcaaccagaccgcagagaauccuguuuuuacuguauucaaagauaaugaaguacuuuacagagcacaacuagccuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 1080 - RNA, 1650 nt, Artificial Sequence
  derived and/or modified CDS sequence (wt) from Nipah henipavirus__ACT32615__H1N1-HA(1-17)_G(70-602)
augaaggcaauacuaguaguucugcuauauacauuugcaaccgcaaaugcacaaaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuaucccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguauacaacaaugaauucuauuaugugcuuugugcagugucaguuguuggagacccuguucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguagguuuuuuggucaggacagaguucaaauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucagccuguuuucuaccaagcgucuuuuucaugggacacuaugauuaaauuuggagauguccaaacaguuaacccuuuaguuguaaauuggcgugacaacacgguaaucucaagaccugggcaaucacaaugcccuagauucaacaagugcccagagguuugcugggaagggguuuauaaugaugccuuccugauugauagaaucaauuggauaagugcggguguauuccuugacagcaaccagaccgcagagaauccuguuuuuacuguauucaaagauaaugaaguacuuuacagagcacaacuagcuuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 1081 - RNA, 1650 nt, Artificial Sequence
  derived and/or modified CDS sequence (wt) from Nipah henipavirus__CAF25497__H1N1-HA(1-17)_G(70-602)
augaaggcaauacuaguaguucugcuauauacauuugcaaccgcaaaugcacaaaauuacacaagaucaacagacaaucaggccgugaucaaagaugcguugcaagguauccaacagcagaucaaagggcuugcugacaaaaucggcacagagauagggcccaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacucccuuuuagagaguauaggccacagacagaaggggugagcaaucugguaggauuaccuaauaauauuugccugcaaaagacaucuaaucagauauugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucugggccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaguuguauucauugaaauaucugaucaaagauuaucuauuggaucuccuagcaaaaucuaugauucuuugggucaaccuguuuucuaccaagcgucauuuucaugggauacuaugauuaaauuuggagauguucuaacagucaacccucugguugucaauuggcguaauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuuuacuguauucaaagauaaugaaauacuuuauagggcacaacuggcuucugaggacaccaaugcacaaaaaacaauaacuaauuguuuucucuugaagaauaagauuuggugcauaucauugguugagauauaugacacaggagacaaugucauaagacccaaacuauucgcgguuaagauaccagagcaauguacauaa

SEQ ID NO: 1082 - RNA, 1650 nt, Artificial Sequence
  derived and/or modified CDS sequence (wt) from Nipah henipavirus__CBM41034__H1N1-HA(1-17)_G(70-602)
augaaggcaauacuaguaguucugcuauauacauuugcaaccgcaaaugcacaaaauuacacaagaucaacagacaaucaggccgugaucaaagaugcguugcaggguauccaacagcagaucaaagggcuugcugacaaaaucggcacagagauagggccuaaaguaucacugauugacacauccaguaccauuacuaucccagcuaacauugggcuguuagguucaaagaucagccagucgacugcaaguauaaaugagaaugugaaugaaaaaugcaaauucacacugccucccuugaaaauccacgaauguaacauuucuuguccuaacccacuccccuuuagagaguauaggccgcagacagaaggggugagcaaucugguaggauuaccugauaauauuugccugcaaaagacaucuaaucagauacugaagccaaagcugauuucauacacuuuacccguagucggucaaagugguaccuguaucacagacccauugcuggcuauggacgagggcuauuuugcauauagccaccuggaaagaaucggaucauguucaagaggggucuccaaacaaagaauaauaggaguuggagagguacuagacagaggugaugaaguuccuucuuuauuuaugaccaaugucuggaccccaccaaauccaaacaccguuuaccacuguagugcuguauacaacaaugaauucuauuauguacuuugugcagugucaacuguuggagacccuauucugaauagcaccuacugguccggaucucuaaugaugacccgucuagcugugaaacccaagaguaaugguggggguuacaaucaacaucaacuugcccuacgaaguaucgagaaagggagguaugauaaaguuaugccguauggaccuucaggcaucaaacagggugacacccuguauuuuccugcuguaggauuuuuggucaggacagaguuuaaauacaaugauucaaauugucccaucacgaagugucaauacaguaaaccugaaaauugcaggcuaucuauggggauuagaccaaacagccauuauauccuucgaucuggacuauuaaaauacaaucuaucagauggggagaaccccaaaauuguauucauugaaauaucugaucaaagauuaucuauuggaucuccuagcaaagucuaugauucuuugggucaaccuguuuucuaccaagcgucauuuucaugggauacuaugauuaaauuuggagauguucaaacagucaacccucugguugucaauuggcgugauaacacgguaauaucaagacccgggcaaucacaaugcccuagauucaauacauguccagagaucugcugggaaggaguuuauaaugaugcauuccuaauugacagaaucaauuggauaagcgcggguguauuccuugacagcaaucagaccgcagaaaauccuguuuucacuguauucaaagauaaugaaauacuuuauagggcacaacuggcuucugaggacaccaaugcacaaaaaacaauaacuaauugcuuucucuugaagaauaagauuuggugcauaucauugguugagauauaugacacaggagacaaugucauaagacccaaacuauucgcgguuaagauaccagagcaauguacauaa

SEQ ID NO: 1083 - RNA, 1650 nt, Artificial Sequence
  derived and/or modified CDS sequence (wt) from Nipah henipavirus__AAX51853__H1N1-HA(1-17)_G(70-602)
augaaggcaauacuaguaguucugcuauauacauuugcaaccgcaaaugcacaaaauuauacaagaucaacagacaaucaggccgugaucaaagaugcguugcaggguauccaacagcagaucaaagggcuugcugacaaaaucggcacagagauagggcccaaaguaucacugauugacacauccaguacuauuacuaucccagcuaacauugggcuguuagguucaaagaucagccagucgacugcaaguauaaaugagaaugugaaugaaaaauguaaauucacauugccucccuugaaaauccacgaauguaacauuucuugucccaacccacucccuuuuagagaguauaggccgcagacagaaggagugagcaaucugguaggauuaccuaauaauauuugccugcaaaagacaucuaaucagauacugaagccaaagcugauuucauacacuuuaccuguagucggucaaagugguaccuguaucacagacccauugcuggcuauggacgagggcuauuuugcauauagccaccuggaaagaaucggaucauguucaagaggggucuccaaacaaaaaauaauaggaguuggagagguacuagacagaggugaugaaguuccuucuuuauuuaugaccaaugucuggaccccaccaaauccaaacacuguuuaccacuguagugcuguauacaacaaugaauucuauuaugugcuuugugcagugucaacuguuggagacccuauucugaauagcaccuacugguccggaucucuaaugaugacccgucuagcuguaaaacccaagaguaaugauggggguuacaaucaacaucaacuugcccuacgaaguaucgagaaagggagguaugauaaagucaugccguauggaccuucaggcaucaaacagggugacacccuguauuuuccugcuguaggauuuuuggucaggacagaguucaaauacaaugauucaaauugucccaucacgaagugucaauacaguaaaccugaaaauugcaggcuaucuauggggauuagaccaaacagccauuauguccuucgaucuggacuauuaaaauacaaucuaucagauggggagaacccuaaaauuguauucauugaaauaucugaucaaagauuaucuauuggaucuccuagcaaaaucuaugauucuuugggucaaccuguuuucuaccaagcgucauuuucaugggauacuaugauuaaauuuggagauguucaaacagucaacccuuugguuguaaguuggcgugauaacacgguaauaucaagaccugggcaaucgcaaugcccuagauucaauacauguccagagaucugcugggaaggaguuuauaaugaugcauuccuaauugacagaaucaauuggauaagcgcagguguauuccuugacagcaaucagaccgcagaaaauccuguuuuuacuguauucaaagauaaugaaauacuuuauagagcacaacuggcuucugaggacaccaaugcacaaaaaacaauaacuaauugcuuucucuugaagaauaagauuuggugcauaucauugguugagauauaugacacaggagacaaugucauaagacccaaacuauucgcaguuaagauaccagagcaauguacauaa

SEQ ID NO: 1084 - RNA, 1650 nt, Artificial Sequence
  derived and/or modified CDS sequence (wt) from Nipah henipavirus__AEZ01397__H1N1-HA(1-17)_G(70-602)
augaaggcaauacuaguaguucugcuauauacauuugcaaccgcaaaugcacaaaacuacacaagaucaacagauaaucaggccaugaucaaagaugcauugcagaguauccagcagcagaucaaggggcuugccgacaaaauuggcacagagauagggccgaaaguaucacugauugauacauccaguacuaucacuauuccagcuaauauugggcuguuagguucaaagaucagccagucaacugcaaguauaaaugagaaugugaaugaaaaaugcaaauuuacacugccucccuugaaaauccacgaauguaacauuucuuguccuaacccacucccuuuuagagaguauaagccgcagacagaaggagugagcaaucugguaggauuaccuaauaauaucugucugcaaaagacaucuaaucagauacugaaaccaaagcugauuucauacaccuuacccguagucggucaaaguggcaccuguaucacagacccacugcuggcuauggaugagggcuacuuugcauauagccaccuggaaaaaaucggaucauguucaagaggggucuccaaacaaagaauaauaggaguuggagagguacuagacagaggugacgaaguaccuucuuuguuuaugacuaacgucuggaccccaucaaauccaaacaccguuuaccauugcagugccguguacaacaaugaauucuauuaugugcuuugugcagugucaguuguuggagacccuauucugaauagcaccuacugguccggaucacuaaugaugacucgucuagcuguaaaaccuaagaauaauggugagaguuacaaucaacaucaauuugccuuacggaauauugagaaagggaaguaugauaaaguuaugccauauggacccucaggcaucaaacaaggugacacccuguacuuuccugcuguaggauuuuuggucaggacagaguucacauacaaugauucaaauugucccaucgcagagugucaauacagcaaaccugaaaacugcaggcuaucuauggggauuagaccaaacagucauuauauccuucgaucuggacuacuaaaauacaaucuaucggaugaggagaacucuaaaauuguauucauugaaauaucugaucaaagacuaucuauuggaucuccuagcaaaaucuaugauucuuugggucaaccuguuuucuaccaagcaucuuuuucaugggacacuaugauuaaauuuggagauguccaaacaguuaacccuuuaguuguaaauuggcgugacaacacgguaaucucaagaccugggcaaucacaaugcccuagauucaacaagugcccagagguuugcugggaagggguuuauaaugaugcuuuccugauugauagaaucaauuggauaagcgcggguguauuccuugacagcaaccagaccgcagagaauccuguuuuuacuguauucaaagauaaugaaguacuuuacagagcacaacuagcuuccgaggacaccaaugcacaaaaaacaauaacuaauugcuuccuuuugaagaauaagaucugguguauaucacugguugagauauacgacacaggagacaauguuauaagaccuaaacuauucgcaguuaagauaccagagcaauguacauaa

SEQ ID NO: 1085 - RNA, 1656 nt, Artificial Sequence
  derived and/or modified CDS sequence (wt) from Hendra henipavirus__NP_047112__H1N1-HA(1-17)_G(70-604)
augaaggcaauacuaguaguucugcuauauacauuugcaaccgcaaaugcacaaaauuacaccagaacgacugauaaucaggcacuaaucaaagagucacuccagaguguacagcaacaaaucaaagcuuuaacagacaaaaucgggacagagauaggccccaaagucucacuaauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaacuaaaguugaaagagggaaguacgauaaggugaugccuuacgguccaucagguaucaagcaaggggauacauuguacuuuccggccgucgguuuuuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucuaucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuauuugcagucaagauaccugcccaauguucagagaguuga

SEQ ID NO: 1086 - RNA, 1656 nt, Artificial Sequence
  derived and/or modified CDS sequence (wt) from Hendra henipavirus__AEB21225__H1N1-HA(1-17)_G(70-604)
augaaggcaauacuaguaguucugcuauauacauuugcaaccgcaaaugcacaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacgucaacaaucuuaaagcccaggcugauauccuauacucuaccaauuaauaccagagaagggguuugcaucacugacccacuuuuggcuguugauaauggcuucuucgccuauagccaucuugaaaagaucggaucaugcacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaauggguguuaacuccaaaagucauuauauuuugagaucaggacuauugaaguauaaucugucucuuggaggagacaucacacuccaauuuaucgagauugcugacaauagauugaccaucgguucuccuaguaagauauacaauucucuaggucaaccugucuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 1087 - RNA, 1656 nt, Artificial Sequence
  derived and/or modified CDS sequence (wt) from Hendra henipavirus__AEB21216__H1N1-HA(1-17)_G(70-604)
augaaggcaauacuaguaguucugcuauauacauuugcaaccgcaaaugcacaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaauccuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucacugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucgcuauaaauaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucgaugggugucaacuccaaaagucauuauauuuugagaucaggacuauugaaguauaaucugucucuaggaggagacaucauacuucaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 1088 - RNA, 1656 nt, Artificial Sequence
  derived and/or modified CDS sequence (wt) from Hendra henipavirus__AEB21206__H1N1-HA(1-17)_G(70-604)
augaaggcaauacuaguaguucugcuauauacauuugcaaccgcaaaugcacaaaauuacaccagaacgacugauaaucaggcacuaaucaaagagucgcuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggaaacuacaaucagaaauacaucgcuauaacuaaaguugaaagagggaaguacgauaaggugaugccuuacgguccaucagguaucaagcaaggggauacauuguacuuuccggccgucgguuuuuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucuaucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauauugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuauuugcagucaagauaccugcccaauguucagagaguuga

SEQ ID NO: 1089 - RNA, 1656 nt, Artificial Sequence
  derived and/or modified CDS sequence (wt) from Hendra henipavirus__AEQ38052__H1N1-HA(1-17)_G(70-604)
augaaggcaauacuaguaguucugcuauauacauuugcaaccgcaaaugcacaaaacuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucacuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugcuguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 1090 - RNA, 1656 nt, Artificial Sequence
  derived and/or modified CDS sequence (wt) from Hendra henipavirus__AEQ38115__H1N1-HA(1-17)_G(70-604)
augaaggcaauacuaguaguucugcuauauacauuugcaaccgcaaaugcacaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuaggggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcaguaucccaugugggagauccuauccuuaacaguacuuccuggacagagucacugucucugauucgucuugcuguaagaccaaaaagugauaauggagacuacaaucagaaauacaucgcuauaacuaaaguugaaagagggaaguacgauaaggugaugccuuacgguccaucagguaucaagcaaggggauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucucuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaccggcuaaacuggguuagugcugguguuuauuuaaacaguaaccaaacugcagagaacccuguguuugccguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 1091 - RNA, 1656 nt, Artificial Sequence
  derived and/or modified CDS sequence (wt) from Hendra henipavirus__AEQ38108__H1N1-HA(1-17)_G(70-604)
augaaggcaauacuaguaguucugcuauauacauuugcaaccgcaaaugcacaaaauuacaccagaacgacugauaaucaggcacuaaucaaagagucacuccagaguguacagcaacaaaucaaagcuuuaacagacaaaaucgggacagagauaggccccaaagucucacugauugacacauccagcaccaucacaauuccugcuaacauaggguuacugggauccaagauaagucagucuaccagcaguauuaaugagaauguuaacgauaaaugcaaauuuacucuuccuccuuuaaagauucaugaguguaauaucucuuguccgaauccuuugccuuucagagaauaccgaccaaucucacaaggggugagugaucuuguaggacugccgaaccagaucugucuacagaagacaacaucaacaaucuuaaagcccaggcugauauccuauacucuaccaauuaauaccagagaagggguuugcaucacugacccacuuuuggcuguugauaauggcuucuucgccuauagccaucuugaaaagaucggaucauguacuagaggaauugcaaaacaaaggauaauaggggugggugagguauuggauaggggugauaaggugccaucaauguuuaugaccaauguuuggacaccacccaauccaagcaccauccaucauugcagcucaacuuaccaugaagauuuuuauuacacauugugcgcagugucccaugugggagauccuauccuuaacaguacuuccuggacagagucacugucucugauucgucuugcuguaagaccaaaaagugauaguggagacuacaaucagaaauacaucacuauaacuaaaguugaaagagggaaguacgauaaggugaugccuuacgguccaucagguaucaagcaagggaauacauuguacuuuccggccgucgguuucuugccaaggaccgaauuucaauauaaugacucuaauugucccauaauucauugcaaguacagcaaagcagaaaacuguaggcuuucaaugggugucaacuccaaaagucauuauauuuugagaucaggacuauugaaguauaaucugucucuuggaggagacaucauacuccaauuuaucgagauugcugacaauagauugaccaucgguucuccuaguaagauauacaauucccuaggucaacccguuuucuaccaggcaucauauucuugggauacgaugauuaaauuaggcgauguugauaccguugacccucuaagaguacaguggagaaauaacagugugauuucuagaccuggacagucacaguguccucgauuuaaugucugucccgagguaugcugggaagggacauauaaugaugcuuuucuaauagaucggcuaaacuggguuagugcugguguuuauuuaaacaguaaccaaacugcagagaacccuguguuugcuguauucaaggauaacgagauccuuuaccaaguuccacuggcugaagaugacacaaaugcacaaaaaaccaucacagauugcuucuugcuggagaaugucauaugguguauaucacuaguagaaauauacgauacaggagacagugugauaaggccaaaacuguuugcagucaagauaccugcccaauguucagagaguuga

SEQ ID NO: 1092 - RNA, 1656 nt, Artificial Sequence
  derived and/or modified CDS sequence (wt) from Hendra henipavirus__AAV80426__H1N1-HA(1-17)_G(70-604)
augaaggcaauacuaguaguucugcuauauacauuugcaaccgcaaaugcacagaacuacacccggaccaccgauaaucaggcccugaucaaggagagccugcagucugugcagcagcagaucaaggcccugaccgacaagaucggcacagagaucggcccuaaagugagccugaucgacaccagcagcaccaucaccauccccgccaauaucggacugcugggcuccaagaucagccagugcaccagcuccaucaacgagaacgugaacgacaagugcaaguucacccugcccccccugaagauccacgagugcaacaucagcugccccaacccccugcccuucagagaguacaggcccaucagccagggagugagcgaucuggugggccugcccaaucagaucugccugcagaaaaccaccuccaccauccugaagccccggcugaucagcuacacccugcccaucaacacaagagagggcgugugcaucaccgauccucugcuggccguggacaacggcuucuucgccuacagccaccuggagaagaucggcagcugcacaagaggcaucgccaagcagagaaucaucggcgugggcgaagugcuggacagaggcgacaaagugcccagcauguucaugaccaacguguggacccccccuaauccuagcaccauccaccacugcagcagcaccuaccacgaggacuucuacuacacccugugcgccgugucucaugugggcgaccccauccugaauagcaccagcuggaccgagagccugucccugauuagacuggccgugaggcccaagagcgauagcggcgacuacaaccagaaguacaucgccaucaccaaaguggagcggggcaaguacgacaaagugaugcccuauggccccagcggaaucaagcagggcgacacccuguacuuucccgccgugggcuuucugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugacaaucggcagccccagcaagaucuacaacagccugggccagcccguguuuuaccaggccagcuacagcugggacaccaugaucaagcugggcgauguggacacaguggacccccugagagugcaguggcggaacaacagcgugaucagcagaccuggccagagccagugccccagauucaacgugugccccgaaguguguugggagggcagcuacaacgacgccuuccugaucgaccggcugaauugggugagcgccggaguguaccugaacagcaaccagaccgccgagaacccuguguucgccguguucaaggacaacgagauccuguaccaagugccccuggccgaggaugauaccaacgcccagaaaaccaucaccgacugcuuccugcuggagaacgugaucuggugcaucagccugguggagaucuacgacaccggcgacagcgugauuaggcccaagcuguucgcugugaagaucccugcccagugcagcgagagcuga

SEQ ID NO: 1093 - RNA, 1614 nt, Artificial Sequence
  derived and/or modified CDS sequence (opt1) from Nipah henipavirus__AAK50553__H1N1-HA(1-17)_F(27-546)
augaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccuga

SEQ ID NO: 1094 - RNA, 1614 nt, Artificial Sequence
  derived and/or modified CDS sequence (opt1) from Nipah henipavirus__AEZ01388__H1N1-HA(1-17)_F(27-546)
augaaggccauccuggugguccuccuguacaccuucgccaccgcgaacgccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccuga

SEQ ID NO: 1095 - RNA, 1614 nt, Artificial Sequence
  derived and/or modified CDS sequence (opt1) from Nipah henipavirus__AAY43915__H1N1-HA(1-17)_F(27-546)
augaaggccauccuggugguccuccuguacaccuucgccaccgcgaacgccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccuga

SEQ ID NO: 1096 - RNA, 1614 nt, Artificial Sequence
  derived and/or modified CDS sequence (opt1) from Nipah henipavirus__CAF25496__H1N1-HA(1-17)_F(27-546)
augaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacguga

SEQ ID NO: 1097 - RNA, 1614 nt, Artificial Sequence
  derived and/or modified CDS sequence (opt1) from Nipah henipavirus__AAM13405__H1N1-HA(1-17)_F(27-546)
augaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccuga

SEQ ID NO: 1098 - RNA, 1614 nt, Artificial Sequence
  derived and/or modified CDS sequence (opt1) from Nipah henipavirus__CBM41033__H1N1-HA(1-17)_F(27-546)
augaaggccauccuggugguccuccuguacaccuucgccaccgcgaacgccauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccuga

SEQ ID NO: 1099 - RNA, 1614 nt, Artificial Sequence; identical to SEQ ID NO: 1094
  derived and/or modified CDS sequence (opt1) from Nipah henipavirus__AEZ01396__H1N1-HA(1-17)_F(27-546)

SEQ ID NO: 1100 - RNA, 1614 nt, Artificial Sequence
  derived and/or modified CDS sequence (opt1) from Hendra henipavirus__NP_047111__H1N1-HA(1-17)_F(27-546)
augaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacguga

SEQ ID NO: 1101 - RNA, 1614 nt, Artificial Sequence
  derived and/or modified CDS sequence (opt1) from Hendra henipavirus__AEB21233__H1N1-HA(1-17)_F(27-546)
augaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccuga

SEQ ID NO: 1102 - RNA, 1617 nt, Artificial Sequence
  derived and/or modified CDS sequence (opt1) from Hendra henipavirus__AEQ38114__H1N1-HA(1-17)_F(26-546)
augaaggccauccuggugguccuccuguacaccuucgccaccgcgaacgccggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccuga

SEQ ID NO: 1103 - RNA, 1614 nt, Artificial Sequence
  derived and/or modified CDS sequence (opt1) from Hendra henipavirus__AAB39505__H1N1-HA(1-17)_F(27-546)
augaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccuga

SEQ ID NO: 1104 - RNA, 1650 nt, Artificial Sequence
  derived and/or modified CDS sequence (opt1) from Nipah henipavirus__AAK50554__H1N1-HA(1-17)_G(70-602)
augaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccuga

SEQ ID NO: 1105 - RNA, 1650 nt, Artificial Sequence
  derived and/or modified CDS sequence (opt1) from Nipah henipavirus__AEZ01389__H1N1-HA(1-17)_G(70-602)
augaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccuga

SEQ ID NO: 1106 - RNA, 1650 nt, Artificial Sequence
  derived and/or modified CDS sequence (opt1) from Nipah henipavirus__ACT32615__H1N1-HA(1-17)_G(70-602)
augaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccuga

SEQ ID NO: 1107 - RNA, 1650 nt, Artificial Sequence
  derived and/or modified CDS sequence (opt1) from Nipah henipavirus__CAF25497__H1N1-HA(1-17)_G(70-602)
augaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccuga

SEQ ID NO: 1108 - RNA, 1650 nt, Artificial Sequence
  derived and/or modified CDS sequence (opt1) from Nipah henipavirus__CBM41034__H1N1-HA(1-17)_G(70-602)
augaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccuga

SEQ ID NO: 1109 - RNA, 1650 nt, Artificial Sequence
  derived and/or modified CDS sequence (opt1) from Nipah henipavirus__AAX51853__H1N1-HA(1-17)_G(70-602)
augaaggccauccuggugguccuccuguacaccuucgccaccgcgaacgcccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccuga

SEQ ID NO: 1110 - RNA, 1650 nt, Artificial Sequence
  derived and/or modified CDS sequence (opt1) from Nipah henipavirus__AEZ01397__H1N1-HA(1-17)_G(70-602)
augaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacguga

SEQ ID NO: 1111 - RNA, 1656 nt, Artificial Sequence
  derived and/or modified CDS sequence (opt1) from Hendra henipavirus__NP_047112__H1N1-HA(1-17)_G(70-604)
augaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcuga

SEQ ID NO: 1112 - RNA, 1656 nt, Artificial Sequence
  derived and/or modified CDS sequence (opt1) from Hendra henipavirus__AEB21225__H1N1-HA(1-17)_G(70-604)
augaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcuga

SEQ ID NO: 1113 - RNA, 1656 nt, Artificial Sequence
  derived and/or modified CDS sequence (opt1) from Hendra henipavirus__AEB21216__H1N1-HA(1-17)_G(70-604)
augaaggccauccuggugguccuccuguacaccuucgccaccgcgaacgcccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcuga

SEQ ID NO: 1114 - RNA, 1656 nt, Artificial Sequence
  derived and/or modified CDS sequence (opt1) from Hendra henipavirus__AEB21206__H1N1-HA(1-17)_G(70-604)
augaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcuga

SEQ ID NO: 1115 - RNA, 1656 nt, Artificial Sequence
  derived and/or modified CDS sequence (opt1) from Hendra henipavirus__AEQ38052__H1N1-HA(1-17)_G(70-604)
augaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcuga

SEQ ID NO: 1116 - RNA, 1656 nt, Artificial Sequence
  derived and/or modified CDS sequence (opt1) from Hendra henipavirus__AEQ38115__H1N1-HA(1-17)_G(70-604)
augaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccuga

SEQ ID NO: 1117 - RNA, 1656 nt, Artificial Sequence
  derived and/or modified CDS sequence (opt1) from Hendra henipavirus__AEQ38108__H1N1-HA(1-17)_G(70-604)
augaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcuga

SEQ ID NO: 1118 - RNA, 1656 nt, Artificial Sequence
  derived and/or modified CDS sequence (opt1) from Hendra henipavirus__AAV80426__H1N1-HA(1-17)_G(70-604)
augaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcuga

SEQ ID NO: 1119 - RNA, 1614 nt, Artificial Sequence
  derived and/or modified CDS sequence (opt2) from Nipah henipavirus__AAK50553__H1N1-HA(1-17)_F(27-546)
augaaggccauccucgucguccuccucuacaccuucgccaccgccaacgccauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1120 - RNA, 1614 nt, Artificial Sequence
  derived and/or modified CDS sequence (opt2) from Nipah henipavirus__AEZ01388__H1N1-HA(1-17)_F(27-546)
augaaggccauccucgucguccuccucuacaccuucgccaccgccaacgccauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1121 - RNA, 1614 nt, Artificial Sequence
  derived and/or modified CDS sequence (opt2) from Nipah henipavirus__AAY43915__H1N1-HA(1-17)_F(27-546)
augaaggccauccucgucguccuccucuacaccuucgccaccgccaacgccauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguacuccuccgaccuccucuucgucuucggccccaaccuccaggaccccgucuccaacuccaugaccauccaggccaucucccaggccuucggcggcaacuacgagacccuccuccgcacccucggcuacgccaccgagggcuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1122 - RNA, 1614 nt, Artificial Sequence
  derived and/or modified CDS sequence (opt2) from Nipah henipavirus__CAF25496__H1N1-HA(1-17)_F(27-546)
augaaggccauccucgucguccuccucuacaccuucgccaccgccaacgccauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaucgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1123 - RNA, 1614 nt, Artificial Sequence
  derived and/or modified CDS sequence (opt2) from Nipah henipavirus__AAM13405__H1N1-HA(1-17)_F(27-546)
augaaggccauccucgucguccuccucuacaccuucgccaccgccaacgccauccuccacuacgagaagcucuccaagaucggccucgucaagggcgucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaccaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1124 - RNA, 1614 nt, Artificial Sequence
  derived and/or modified CDS sequence (opt2) from Nipah henipavirus__CBM41033__H1N1-HA(1-17)_F(27-546)
augaaggccauccucgucguccuccucuacaccuucgccaccgccaacgccauccuccacuacgagaagcucuccaagaucggccucgucaagggcgucacccgcaaguacaagaucaaguccaacccccucaccaaggacaucgucaucaagaugaucgccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucaucuacgucgaccucuccuccuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaaguccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1125 - RNA, 1614 nt, Artificial Sequence; identical to SEQ ID NO: 1120
  derived and/or modified CDS sequence (opt2) from Nipah henipavirus__AEZ01396__H1N1-HA(1-17)_F(27-546)

SEQ ID NO: 1126 - RNA, 1614 nt, Artificial Sequence
  derived and/or modified CDS sequence (opt2) from Hendra henipavirus__NP_047111__H1N1-HA(1-17)_F(27-546)
augaaggccauccucgucguccuccucuacaccuucgccaccgccaacgccauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucgccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 1127 - RNA, 1614 nt, Artificial Sequence
  derived and/or modified CDS sequence (opt2) from Hendra henipavirus__AEB21233__H1N1-HA(1-17)_F(27-546)
augaaggccauccucgucguccuccucuacaccuucgccaccgccaacgccauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 1128 - RNA, 1617 nt, Artificial Sequence
  derived and/or modified CDS sequence (opt2) from Hendra henipavirus__AEQ38114__H1N1-HA(1-17)_F(26-546)
augaaggccauccucgucguccuccucuacaccuucgccaccgccaacgccggcauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccucuccgaccuccucuucgucuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccaguccggcgagcagacccuccucaugaucgacaacaccaccugcaccaccgucguccucggcaacaucaucaucucccucggcaaguaccucggcuccaucaacuacaacuccgaguccaucgccgucggcccccccgucuacaccgacaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucaucaucgucgagaagaagcgcggcaacuacucccgccucgacgaccgccagguccgccccgucuccaacggcgaccucuacuacaucggcaccuga

SEQ ID NO: 1129 - RNA, 1614 nt, Artificial Sequence
  derived and/or modified CDS sequence (opt2) from Hendra henipavirus__AAB39505__H1N1-HA(1-17)_F(27-546)
augaaggccauccucgucguccuccucuacaccuucgccaccgccaacgccauccuccacuacgagaagcucuccaagaucggccucgucaagggcaucacccgcaaguacaagaucaaguccaacccccucaccaaggacaucgucaucaagaugauccccaacgucuccaacgucuccaagugcaccggcaccgucauggagaacuacaagucccgccucaccggcauccucucccccaucaagggcgccaucgagcucuacaacaacaacacccacgaccucgucggcgacgucaagcucgccggcgucgucauggccggcaucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgaccagaucuccugcaagcagaccgagcucgcccucgaccucgcccucuccaaguaccuccucaucugcuccugcuucggccccaaccuccaggaccccgucuccaacuccaugaccauccaggccaucucccaggccuucggcggcaacuacgagacccuccuccgcacccucggcuacgccaccgaggacuucgacgaccuccucgaguccgacuccaucaccggccagaucgucuacgucgaccucuccuccuacuacaucaucguccgcgucuacuuccccauccucaccgagauccagcaggccuacguccaggagcuccuccccgucuccuucaacaacgacaacuccgaguggaucuccaucguccccaacuucguccucauccgcaacacccucaucuccaacaucgaggucaaguacugccucaucaccaagaaguccgucaucugcaaccaggacuacgccacccccaugaccgccuccguccgcgagugccucaccggcuccaccgacaagugcccccgcgagcucgucgucuccucccacgucccccgcuucgcccucuccggcggcguccucuucgccaacugcaucuccgucaccugccagugccagaccaccggccgcgccaucucccagucccgcgagcagacccuccucaugaucgacaacaccaccugcaccaccgucguccucggcaacaucaucaucucccuccccaaguaccucggcuccaucaagcuccagguccuccgcgcccuccuccucggccaccaguccauccagaccaaggucgacaucuccucccagaucuccuccaugaaccagucccuccagcaguccaaggacuacaucaaggaggcccagaagauccucgacaccgucaaccccucccucaucuccaugcucuccaugaucauccucuacguccucuccaucgccgcccucugcaucggccucaucaccuucaucuccuucgucaucgucgagaagaagcgcggcaacuacucccgccucgacgaccgccagguccgccccgucuccaacggcgaccucuacuacaucggcaccuga

SEQ ID NO: 1130 - RNA, 1650 nt, Artificial Sequence
  derived and/or modified CDS sequence (opt2) from Nipah henipavirus__AAK50554__H1N1-HA(1-17)_G(70-602)
augaaggccauccucgucguccuccucuacaccuucgccaccgccaacgcccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaaggucgucuucaucgagaucuccgaccagcgccucuccaucggcucccccuccaagaucuacgacucccucggccagcccgucuucuaccaggccuccuucuccugggacaccaugaucaaguucggcgacguccucaccgucaacccccucgucgucaacuggcgcaacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 1131 - RNA, 1650 nt, Artificial Sequence
  derived and/or modified CDS sequence (opt2) from Nipah henipavirus__AEZ01389__H1N1-HA(1-17)_G(70-602)
augaaggccauccucgucguccuccucuacaccuucgccaccgccaacgcccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccauccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaaguacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 1132 - RNA, 1650 nt, Artificial Sequence
  derived and/or modified CDS sequence (opt2) from Nipah henipavirus__ACT32615__H1N1-HA(1-17)_G(70-602)
augaaggccauccucgucguccuccucuacaccuucgccaccgccaacgcccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccguccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaaguacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 1133 - RNA, 1650 nt, Artificial Sequence
  derived and/or modified CDS sequence (opt2) from Nipah henipavirus__CAF25497__H1N1-HA(1-17)_G(70-602)
augaaggccauccucgucguccuccucuacaccuucgccaccgccaacgcccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucugggccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaaggucgucuucaucgagaucuccgaccagcgccucuccaucggcucccccuccaagaucuacgacucccucggccagcccgucuucuaccaggccuccuucuccugggacaccaugaucaaguucggcgacguccucaccgucaacccccucgucgucaacuggcgcaacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 1134 - RNA, 1650 nt, Artificial Sequence
  derived and/or modified CDS sequence (opt2) from Nipah henipavirus__CBM41034__H1N1-HA(1-17)_G(70-602)
augaaggccauccucgucguccuccucuacaccuucgccaccgccaacgcccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccgacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagcgcaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacggcggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacauccuccgcuccggccuccucaaguacaaccucuccgacggcgagaaccccaagaucgucuucaucgagaucuccgaccagcgccucuccaucggcucccccuccaaggucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 1135 - RNA, 1650 nt, Artificial Sequence
  derived and/or modified CDS sequence (opt2) from Nipah henipavirus__AAX51853__H1N1-HA(1-17)_G(70-602)
augaaggccauccucgucguccuccucuacaccuucgccaccgccaacgcccagaacuacacccgcuccaccgacaaccaggccgucaucaaggacgcccuccagggcauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguaccgcccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagcgcaucggcuccugcucccgcggcgucuccaagcagaagaucaucggcgucggcgagguccucgaccgcggcgacgagguccccucccucuucaugaccaacgucuggaccccccccaaccccaacaccgucuaccacugcuccgccgucuacaacaacgaguucuacuacguccucugcgccgucuccaccgucggcgaccccauccucaacuccaccuacugguccggcucccucaugaugacccgccucgccgucaagcccaaguccaacgacggcggcuacaaccagcaccagcucgcccuccgcuccaucgagaagggccgcuacgacaaggucaugcccuacggccccuccggcaucaagcagggcgacacccucuacuuccccgccgucggcuuccucguccgcaccgaguucaaguacaacgacuccaacugccccaucaccaagugccaguacuccaagcccgagaacugccgccucuccaugggcauccgccccaacucccacuacguccuccgcuccggccuccucaaguacaaccucuccgacggcgagaaccccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucuccuggcgcgacaacaccgucaucucccgccccggccagucccagugcccccgcuucaacaccugccccgagaucugcugggagggcgucuacaacgacgccuuccucaucgaccgcaucaacuggaucuccgccggcgucuuccucgacuccaaccagaccgccgagaaccccgucuucaccgucuucaaggacaacgagauccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 1136 - RNA, 1650 nt, Artificial Sequence
  derived and/or modified CDS sequence (opt2) from Nipah henipavirus__AEZ01397__H1N1-HA(1-17)_G(70-602)
augaaggccauccucgucguccuccucuacaccuucgccaccgccaacgcccagaacuacacccgcuccaccgacaaccaggccaugaucaaggacgcccuccaguccauccagcagcagaucaagggccucgccgacaagaucggcaccgagaucggccccaaggucucccucaucgacaccuccuccaccaucaccauccccgccaacaucggccuccucggcuccaagaucucccaguccaccgccuccaucaacgagaacgucaacgagaagugcaaguucacccuccccccccucaagauccacgagugcaacaucuccugccccaacccccuccccuuccgcgaguacaagccccagaccgagggcgucuccaaccucgucggccuccccaacaacaucugccuccagaagaccuccaaccagauccucaagcccaagcucaucuccuacacccuccccgucgucggccaguccggcaccugcaucaccgacccccuccucgccauggacgagggcuacuucgccuacucccaccucgagaagaucggcuccugcucccgcggcgucuccaagcagcgcaucaucggcgucggcgagguccucgaccgcggcgacgagguccccucccucuucaugaccaacgucuggacccccuccaaccccaacaccgucuaccacugcuccgccgucuacaacaacgaguucuacuacguccucugcgccgucuccgucgucggcgaccccauccucaacuccaccuacugguccggcucccucaugaugacccgccucgccgucaagcccaagaacaacggcgaguccuacaaccagcaccaguucgcccuccgcaacaucgagaagggcaaguacgacaaggucaugcccuacggccccuccggcaucaagcagggcgacacccucuacuuccccgccgucggcuuccucguccgcaccgaguucaccuacaacgacuccaacugccccaucgccgagugccaguacuccaagcccgagaacugccgccucuccaugggcauccgccccaacucccacuacauccuccgcuccggccuccucaaguacaaccucuccgacgaggagaacuccaagaucgucuucaucgagaucuccgaccagcgccucuccaucggcucccccuccaagaucuacgacucccucggccagcccgucuucuaccaggccuccuucuccugggacaccaugaucaaguucggcgacguccagaccgucaacccccucgucgucaacuggcgcgacaacaccgucaucucccgccccggccagucccagugcccccgcuucaacaagugccccgaggucugcugggagggcgucuacaacgacgccuuccucaucgaccgcaucaacuggaucuccgccggcgucuuccucgacuccaaccagaccgccgagaaccccgucuucaccgucuucaaggacaacgagguccucuaccgcgcccagcucgccuccgaggacaccaacgcccagaagaccaucaccaacugcuuccuccucaagaacaagaucuggugcaucucccucgucgagaucuacgacaccggcgacaacgucauccgccccaagcucuucgccgucaagauccccgagcagugcaccuga

SEQ ID NO: 1137 - RNA, 1656 nt, Artificial Sequence
  derived and/or modified CDS sequence (opt2) from Hendra henipavirus__NP_047112__H1N1-HA(1-17)_G(70-604)
augaaggccauccucgucguccuccucuacaccuucgccaccgccaacgcccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 1138 - RNA, 1656 nt, Artificial Sequence
  derived and/or modified CDS sequence (opt2) from Hendra henipavirus__AEB21225__H1N1-HA(1-17)_G(70-604)
augaaggccauccucgucguccuccucuacaccuucgccaccgccaacgcccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucacccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 1139 - RNA, 1656 nt, Artificial Sequence
  derived and/or modified CDS sequence (opt2) from Hendra henipavirus__AEB21216__H1N1-HA(1-17)_G(70-604)
augaaggccauccucgucguccuccucuacaccuucgccaccgccaacgcccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaacaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 1140 - RNA, 1656 nt, Artificial Sequence
  derived and/or modified CDS sequence (opt2) from Hendra henipavirus__AEB21206__H1N1-HA(1-17)_G(70-604)
augaaggccauccucgucguccuccucuacaccuucgccaccgccaacgcccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcaacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacaucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 1141 - RNA, 1656 nt, Artificial Sequence
  derived and/or modified CDS sequence (opt2) from Hendra henipavirus__AEQ38052__H1N1-HA(1-17)_G(70-604)
augaaggccauccucgucguccuccucuacaccuucgccaccgccaacgcccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucaccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 1142 - RNA, 1656 nt, Artificial Sequence
  derived and/or modified CDS sequence (opt2) from Hendra henipavirus__AEQ38115__H1N1-HA(1-17)_G(70-604)
augaaggccauccucgucguccuccucuacaccuucgccaccgccaacgcccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacaacggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 1143 - RNA, 1656 nt, Artificial Sequence
  derived and/or modified CDS sequence (opt2) from Hendra henipavirus__AEQ38108__H1N1-HA(1-17)_G(70-604)
augaaggccauccucgucguccuccucuacaccuucgccaccgccaacgcccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccaguccaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucaccaucaccaaggucgagcgcggcaaguacgacaaggucaugcccuacggccccuccggcaucaagcagggcaacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcaccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 1144 - RNA, 1656 nt, Artificial Sequence
  derived and/or modified CDS sequence (opt2) from Hendra henipavirus__AAV80426__H1N1-HA(1-17)_G(70-604)
augaaggccauccucgucguccuccucuacaccuucgccaccgccaacgcccagaacuacacccgcaccaccgacaaccaggcccucaucaaggagucccuccaguccguccagcagcagaucaaggcccucaccgacaagaucggcaccgagaucggccccaaggucucccucaucgacaccuccuccaccaucaccauccccgccaacaucggccuccucggcuccaagaucucccagugcaccuccuccaucaacgagaacgucaacgacaagugcaaguucacccuccccccccucaagauccacgagugcaacaucuccugccccaacccccuccccuuccgcgaguaccgccccaucucccagggcgucuccgaccucgucggccuccccaaccagaucugccuccagaagaccaccuccaccauccucaagccccgccucaucuccuacacccuccccaucaacacccgcgagggcgucugcaucaccgacccccuccucgccgucgacaacggcuucuucgccuacucccaccucgagaagaucggcuccugcacccgcggcaucgccaagcagcgcaucaucggcgucggcgagguccucgaccgcggcgacaagguccccuccauguucaugaccaacgucuggaccccccccaaccccuccaccauccaccacugcuccuccaccuaccacgaggacuucuacuacacccucugcgccgucucccacgucggcgaccccauccucaacuccaccuccuggaccgagucccucucccucauccgccucgccguccgccccaaguccgacuccggcgacuacaaccagaaguacaucgccaucaccaaggucgagcgcggcaaguacgacaaggucaugcccuacggccccuccggcaucaagcagggcgacacccucuacuuccccgccgucggcuuccucccccgcaccgaguuccaguacaacgacuccaacugccccaucauccacugcaaguacuccaaggccgagaacugccgccucuccaugggcgucaacuccaagucccacuacauccuccgcuccggccuccucaaguacaaccucucccucggcggcgacaucauccuccaguucaucgagaucgccgacaaccgccucaccaucggcucccccuccaagaucuacaacucccucggccagcccgucuucuaccaggccuccuacuccugggacaccaugaucaagcucggcgacgucgacaccgucgacccccuccgcguccaguggcgcaacaacuccgucaucucccgccccggccagucccagugcccccgcuucaacgucugccccgaggucugcugggagggcuccuacaacgacgccuuccucaucgaccgccucaacugggucuccgccggcgucuaccucaacuccaaccagaccgccgagaaccccgucuucgccgucuucaaggacaacgagauccucuaccaggucccccucgccgaggacgacaccaacgcccagaagaccaucaccgacugcuuccuccucgagaacgucaucuggugcaucucccucgucgagaucuacgacaccggcgacuccgucauccgccccaagcucuucgccgucaagauccccgcccagugcuccgaguccuga

SEQ ID NO: 1145 - RNA, 1614 nt, Artificial Sequence
  derived and/or modified CDS sequence (opt3) from Nipah henipavirus__AAK50553__H1N1-HA(1-17)_F(27-546)
augaaggccauccuggugguccuccuuuacaccuucgcuacagcaaacgccauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaccgaggacuuugaugaccugcucgagagugauagcaucacaggucagauaauuuacguggaccuuucuuccuauuacaucaucguacguguguauuucccaauucugaccgaaauccaacaggccuacauucaggaguugcuacccgucucauuuaacaaugacaacagcgaauggauaaguaucgugccuaauuucauucugguuagaaacacgcucaucucuaauaucgagauuggcuuuugucugauaacuaagagguccgugaucugcaaccaggauuaugcaacaccaaugaccaauaacaugcgggaaugucuuacugggagcacagagaaaugcccccgcgagcuggucgugucgucucacguaccuagauucgcuuuguccaauggaguucucuuugccaacuguauuucagugaccugccaaugucagacgaccggcagggcgaucagucagagcggugaacaaacacuguuaaugauugacaauacuaccugcccaacagccguccuggggaacgugaucauaucccuaggaaaguaccucggcucugucaauuacaacagcgagggcaucgcaauugggccgcccguguucacugauaagguugacaucucaagucagauuuccagcaugaaucagucucugcagcaaucaaaagauuauaucaaggaagcucagcggcuuuuggacaccgugaacccuagucugauaagcaugcucuccaugauuauccuguacguacuuucuauugccucgcugugcaucggauugauaacauuuaucagcuucauuaucgucgagaaaaagcgcaacaccuauucccgacucgaagauagaagggugcggccaacuucaaguggugaccuguacuauauuggcacguga

SEQ ID NO: 1146 - RNA, 1614 nt, Artificial Sequence
  derived and/or modified CDS sequence (opt3) from Nipah henipavirus__AEZ01388__H1N1-HA(1-17)_F(27-546)
augaaggccauccuggugguccuccuuuacaccuucgcuacagcaaacgccaucuuacacuacgaaaaacugucaaagauugggcuaguuaaaggaaucaccaggaaguauaaaauaaagaguaacccccucacaaaggacaucgugauuaaaaugaucccuaauguaagcaacaugucccaguguacugguucugugauggagaauuacaagacgcggcugaacggcauucuuaccccaaucaaaggggcucuggaaauauauaagaauaacacacaugauuuggucggagacgugcgccucgcaggcguuauuauggccgguguggcgaucgggauugcuacugccgcacaaaucaccgccggagucgcucuguacgaggcaaugaaaaaugccgauaacaucaauaagcugaagucgucaauugaaagcacaaacgaggcugugguaaaacuccaggagaccgccgaaaagacuguuuauguguuaacagcgcugcaggacuacauaaauaccaaccuugucccgacgaucgauaaaauuaguugcaagcagacugaguugucccuggaccuagcacucucuaaauaccugagcgaucuucuguucguguuuggccccaauuugcaagacccuguguccaacucaaugaccauccaggccauaagucaggcuuucggcgggaacuaugaaacacuccugcgaacuuuaggauacgccaccgaggauuuugacgaucugcucgagagcgacucuauuacaggucagaucaucuaugucgaucuuuccggcuacuauauuaucguucguguguacuucccaauucugaccgaaauacaacaggcauauauccaggaguugcuacccguaucauuuaauaacgacaauagcgaauggauuaguaucgugccuaacuucauccuggucagaaauacgcucauuucuaacauagagaucggguuuugucugauuacuaagagguccgugaucugcaaucaggacuacgcuacaccaaugaccaacaauaugcgggaaugucuuacuggaagcacagagaaaugcccccgcgagcugguugugucgucucacgucccuagauucgccuuguccaacggcgugcucuuugcgaauuguauuucaguaaccugccaaugucagacgaccgguagggccaucagucagagcggggaacaaacacuguuaaugauagauaacacuaccugcccaacagcaguucugggaaaugugaucauuucccuaggcaaguaccucggcucugucaacuauaauagcgaggggaucgcuauuggaccgcccguguucacugacaaggucgauaucucaagucagauauccagcaugaaccagucucugcagcaaucaaaagacuacauuaaggaagcccagcggcuuuuggauaccgugaacccuagucugaucagcaugcucuccaugauuauccuguauguucuuucuauagcuucgcuguguaucgguuugauuacauuuaucagcuucauuaucguggagaaaaagcgcaauaccuacucccgacucgaagacagaaggguacggccaacuucaaguggcgaucuguauuacauagggacguga

SEQ ID NO: 1147 - RNA, 1614 nt, Artificial Sequence
  derived and/or modified CDS sequence (opt3) from Nipah henipavirus__AAY43915__H1N1-HA(1-17)_F(27-546)
augaaggccauccuggugguccuccuuuacaccuucgcuacagcaaacgccauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauacagcuccgaucugcuuuucguguuuggccccaaucugcaagacccugugucaaacaguaugaccauucaggccaucagccaggcuuucggcgggaacuaugaaacauugcuccgaacucugggauacgccaccgaggguuuugaugacuuacuggagucugauuccauaacaggccagauuaucuaugucgaccucucaggguacuauaucauuguucguguguacuucccaauccuuaccgaaauucaacaggcauauauacaggagcuguugcccguaaguuuuaauaacgauaauagugaauggaucucuauugugccuaacuucauccuagucagaaauacgcugaucuccaacauugagauaggauuuugucucaucacuaagaggagcgugauuugcaaucaggacuacgcuacaccaaugaccaacaauaugcgggaaugucugacuggcucgacagagaaaugcccccgcgagcuuguugugucuucccacgucccuagauucgcccugucaaacgguguguuguuugcgaauuguaucaguguaaccugccaaugucagacgaccgggagggccauuagccaguccggagaacaaacacuccugaugaucgacaacacuaccugcccaacagcaguuuuaggcaaugugauaaucucucugggcaaguaccuagggagcgucaacuauaauucagagggaauugcuaucgguccgcccguguucacugauaaggucgacauuaguucccagaucagcucuaugaaccagucacuccagcaaaguaaagauuacauaaaggaagcccagcggcugcuugacaccgugaacccuagcuugauuuccaugcugucuaugaucauucucuauguucugucgaucgcuagccuuuguauaggccugaucacauuuauuuccuucaucauuguggagaaaaagcgcaauaccuacucacgauuggaagauagaaggguacggccaacuagcucuggggaccucuauuacaucggaacguga

SEQ ID NO: 1148 - RNA, 1614 nt, Artificial Sequence
  derived and/or modified CDS sequence (opt3) from Nipah henipavirus__CAF25496__H1N1-HA(1-17)_F(27-546)
augaaggccauccuggugguccuccuuuacaccuucgcuacagcaaacgccauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaucgaggacuuugaugaccugcucgagagugauagcauaaccggucagauuaucuacguggaccuuucuuccuauuacaucauuguacguguguauuucccaauccugacagaaauucaacaggccuacauacaggaguugcuacccgucucauuuaacaaugacaacagcgaauggaucaguauugugccuaauuucauccugguuagaaacacccucaucucuaauauugagauaggcuuuugucugaucacgaagagguccgugauuugcaaccaggauuaugcaacuccaaugacaaauaacaugcgggaaugucuuaccgggagcacugagaaaugcccccgcgagcuggucgugucgucucacguaccuagauucgcuuuguccaauggaguucucuuugccaacuguaucucagugacaugccaaugucagaccacgggcagggcgauuagucagagcggugaacaaacccuguuaaugaucgacaauacaacuugcccaaccgccguccuggggaacgugauaaucucccuaggaaaguaccucggcucugucaauuacaacagcgagggcauugcaaucgggccgcccguguucacagauaagguugacauuucaagucagaucuccagcaugaaucagucucugcagcaaucaaaagauuauauaaaggaagcucagcggcuuuuggacacugugaacccuagucugauuagcaugcucuccaugaucauucuguacguacuuucuaucgccucgcugugcauaggauugaucaccuuuauuagcuucaucauugucgagaaaaagcgcaacacauauucccgacucgaagauagaagggugcggccaaccucaaguggugaccuguacuauaucggcacuuga

SEQ ID NO: 1149 - RNA, 1614 nt, Artificial Sequence
  derived and/or modified CDS sequence (opt3) from Nipah henipavirus__AAM13405__H1N1-HA(1-17)_F(27-546)
augaaggccauccuggugguccuccuuuacaccuucgcuacagcaaacgccauuuuacacuaugaaaaacugucuaagaucgggcuagugaaaggaguaaccaggaaguacaaaauuaagucaaauccccucacaaaggauaucgugauaaaaaugaucccuaacgucaguaauaugagccaguguacugguuccgugauggagaacuauaagacgcggcugaauggcauucuuaccccaaucaaaggggcccuggaaauuuacaagaacaauacacaugacuugguuggagaugugcgccucgcuggcgucaucauggccgguguggcaauagggauugcgacugcugcccaaaucaccgcaggaguagcccuguaugaggcuaugaaaaacgcagacaauauuaacaagcugaagucuucgaucgaaucaacaaaugaggccguugugaaacuccaggagaccgcugaaaagacugucuacguguuaacagcccugcaggauuauaucaacaccaaucuugugccgacgauugacaaaauaagcugcaagcagacugaguugagucuggaucuagcgcucuccaaauaccugucugaccuucuguucgucuuuggccccaacuugcaagauccuguuagcaauuccaugaccauccaggcaauuucacaggccuucggcgggaacuacgaaacacuccugcgaacuuuaggauaugcuaccgaggacuuugaugaccugcucgagagugauagcaucacaggucagauaauuuacguggaccuuucuuccuauuacaucaucguacguguguauuucccaauucugaccgaaauccaacaggccuacauucaggaguugcuacccgucucauuuaacaaugacaacagcgaauggauaaguaucgugccuaauuucauucugguuagaaacacgcucaucucuaauaucgagauuggcuuuugucugauaacuaagagguccgugaucugcaaccaggauuaugcaacaccaaccacuaauaacaugcgggaaugucuuacagggagcaccgagaaaugcccccgcgagcuggucgugucgucucacguaccuagauucgcuuuguccaauggaguucucuuugccaacuguauuucagugacgugccaaugucagaccacaggcagggcgaucagucagagcggugaacaaacucuguuaaugauugacaauaccacaugcccaacugccguccuggggaacgugaucauaucccuaggaaaguaccucggcucugucaauuacaacagcgagggcaucgcaauugggccgcccguguucaccgauaagguugacaucucaagucagauuuccagcaugaaucagucucugcagcaaucaaaagauuauaucaaggaagcucagcggcuuuuggacacagugaacccuagucugauaagcaugcucuccaugauuauccuguacguacuuucuauugccucgcugugcaucggauugauaaccuuuaucagcuucauuaucgucgagaaaaagcgcaacacuuauucccgacucgaagauagaagggugcggccaacgucaaguggugaccuguacuauauuggcacauga

SEQ ID NO: 1150 - RNA, 1614 nt, Artificial Sequence
  derived and/or modified CDS sequence (opt3) from Nipah henipavirus__CBM41033__H1N1-HA(1-17)_F(27-546)
augaaggccauccuggugguccuccuuuacaccuucgcuacagcaaacgccauuuuacacuaugaaaaacugucaaagaucgggcuagugaaaggaguaaccaggaaguacaaaauuaagaguaauccccucacaaaggauaucgugauaaaaaugaucgccaacgucagcaauaugucccagugcacugguucugugauggagaacuauaagacgcggcugaauggcauucuuaccccuaucaaaggggcucuggaaauuuacaagaacaauacacaugacuugguuggagaugugcgccucgcaggcgucaucauggccgguguggcgauagggauugcuacugccgcacaaaucaccgccggaguagcucuguaugaggcaaugaaaaacgccgacaauauuaacaagcugaagucgucaaucgaaagcacaaaugaggcuguugugaaacuccaggagaccgccgaaaagacugucuacguguuaacagcgcugcaggauuauaucaacaccaaucuugugccaacgauugacaaaauaaguuguaagcagacugaguugucccuggaucuagcacucucuaaauaccugagcgaccuucuguucgucuuuggcccgaacuugcaagaucccguuuccaauucaaugaccauccaggccauuagucaggcuuucggcgggaacuacgaaacacuccugcgaacuuuaggauaugccaccgaggacuuugaugaccugcucgagagcgauucuaucacaggucagauaauuuacguggaccuuuccucauauuacaucaucguacguguguauuucccuauucugaccgaaauccaacaggcauacauucaggaguugcuaccagucagcuuuaacaaugacaacagugaauggauaucuaucgugcccaauuucauucugguuagaaacacgcucaucuccaauaucgagauuggcuuuugccugauaacuaagaggagcgugaucuguaaccaggauuaugcuacaccuaugaccaauaacaugcgggaaugccuuacugggucgacagagaaauguccacgcgagcuggucgugucuucccacguacccagauucgccuugucaaauggaguucucuuugcgaacugcauuagugugaccugucaaugccagacgaccggcagggccaucagccaguccggugaacaaacacuguuaaugauugacaauacuaccuguccuacagcaguccuggggaacgugaucauaucucuaggaaaguaccucggcagcgucaauuacaacucagagggcaucgcuauugggccaccgguguucacugauaagguugacaucaguucccagaaaagcucuaugaaucagucacugcagcaaaguaaggauuauauuaaagaagcccagcggcuuuuggacaccgugaaccccagccugaucuccaugcucucuaugauaauucuguacguacuuucgaucgcuagccugugcauuggauugaucacauuuauauccuucaucauugucgagaagaaacgcaacaccuauucacgacucgaagauagaagggugcggccuacgaguucuggugaccuguacuauaucggcacuuga

SEQ ID NO: 1151 - RNA, 1614 nt, Artificial Sequence
  derived and/or modified CDS sequence (opt3) from Nipah henipavirus__AEZ01396__H1N1-HA(1-17)_F(27-546)
augaaggccauccuggugguccuccuuuacaccuucgcuacagcaaacgccauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauaccugagcgaucuucuguucguguuuggccccaauuugcaagacccuguguccaacucaaugaccauucaggccaucagucaggcuuucggcgggaacuaugaaacacuccugcgaacuuuaggauacgccaccgaggauuuugacgaucugcucgagagcgacucuauaacaggucagauuaucuaugucgaucuuuccggcuacuauaucauuguucguguguacuucccaauccugaccgaaauucaacaggcauauauacaggaguugcuacccguaucauuuaauaacgacaauagcgaauggaucaguauugugccuaacuucauccuggucagaaauacgcucaucucuaacauugagauaggguuuugucugaucacuaagagguccgugauuugcaaucaggacuacgcuacaccaaugaccaacaauaugcgggaaugucuuacuggaagcacagagaaaugcccccgcgagcugguugugucgucucacgucccuagauucgccuuguccaacggcgugcucuuugcgaauuguaucucaguaaccugccaaugucagacgaccgguagggccauuagucagagcggggaacaaacacuguuaaugaucgauaacacuaccugcccaacagcaguucugggaaaugugauaaucucccuaggcaaguaccucggcucugucaacuauaauagcgaggggauugcuaucggaccgcccguguucacugacaaggucgauauuucaagucagaucuccagcaugaaccagucucugcagcaaucaaaagacuacauaaaggaagcccagcggcuuuuggauaccgugaacccuagucugauuagcaugcucuccaugaucauucuguauguucuuucuaucgcuucgcuguguauagguuugaucacauuuauuagcuucaucauuguggagaaaaagcgcaauaccuacucccgacucgaagacagaaggguacggccaacuucaaguggcgaucuguauuacaucgggacguga

SEQ ID NO: 1152 - RNA, 1614 nt, Artificial Sequence
  derived and/or modified CDS sequence (opt3) from Hendra henipavirus__NP_047111__H1N1-HA(1-17)_F(27-546)
augaaggccauccuggugguccuccuuuacaccuucgcuacagcaaacgccauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauugcugggcaaaucguguauguagauuugagcucuuacuauauaauugugcgagucuacuucccaauccuaaccgagauccagcaggccuaugugcaggaacugcuccccguuuccuuuaacaacgacaauucagaguggauuagcaucgugccuaacuucguccugauucguaauacgcuuauaaguaacaucgaagugaaguacugccugauuacuaaaaagucuguaaucuguaaucaagacuaugcgacaccaaugaccgccuccguuagagagugcuugacuggaagcacagauaagugucccagggagcucguggucucgucucacgugccucgguuugcacuguccggcggugucuuauucgcuaacugcaucucagugaccugucagugccagacgaccgggcgcgccauuagucaaagcggagaacagacacugcuaaugauagacaauacuaccuguacaacuguugugcucggcaacaucauuaucucccugggcaaauaccuugggucuauuaauuacaacagcgagucaaucgcuguaggaccaccggucuauaccgauaagguggacauaaguucccagaucagcucuaugaaucagucauugcaacagaguaaagauuacauuaaggaagcccagaaaauccuggacacaguuaaccccagccucauuuccaugcugucuaugaucauacuuuaugugcugucgauugcagccuugugcaucggucucauuaccuuuaucagcuucgucauaguggagaagaagagaggcaauuacuccaggcuggaugaccggcagguacgcccugugucaaacggggauuuauauuacaucggaacuuga

SEQ ID NO: 1153 - RNA, 1614 nt, Artificial Sequence
  derived and/or modified CDS sequence (opt3) from Hendra henipavirus__AEB21233__H1N1-HA(1-17)_F(27-546)
augaaggccauccuggugguccuccuuuacaccuucgcuacagcaaacgccauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauuaccgggcaaaucguguauguagauuugagcucuuacuauauaauugugcgagucuacuucccaauccuaacggagauccagcaggcuuaugugcaggaacugcuccccguuuccuuuaacaacgacaauucagaguggauuagcaucgugccuaacuucguccugauucguaauacucuuauaaguaacaucgaagugaaguacugccugauuaccaaaaagucuguaaucuguaaucaagacuaugccacaccaaugacugcguccguuagagagugcuugacaggaagcaccgauaagugucccagggagcucguggucucgucucacgugccucgguuugcccuguccggcggugucuuauucgcaaacugcaucucagugacgugucagugccagaccacagggcgcgcuauuagucaaagcggagaacagacucugcuaaugauagacaauaccacauguacuaccguugugcucggcaacaucauuaucucccugggcaaauaccuugggucuauuaauuacaacagcgagucaaucgccguaggaccaccggucuauacagauaagguggacauaaguucccagaucagcucuaugaaucagucauugcaacagaguaaagauuacauuaaggaagcucagaaaauccuggacaccguuaaccccagccucauuuccaugcugucuaugaucauacuuuaugugcugucgauugccgcauugugcaucggucucauuacuuuuaucagcuucgucauaguggagaagaagagaggcaauuacuccaggcuggaugaccggcagguacgcccugugucaaacggggauuuauauuacaucggaacguga

SEQ ID NO: 1154 - RNA, 1617 nt, Artificial Sequence
  derived and/or modified CDS sequence (opt3) from Hendra henipavirus__AEQ38114__H1N1-HA(1-17)_F(26-546)
augaaggccauccuggugguccuccuuuacaccuucgcuacagcaaacgccggaauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguccgaucucuuguucgucuuugggcccaaucugcaggacccuguuucuaacagcaugacaauacaggcuaucucccaggccuucggagguaauuacgagacuuuacugcgcacccucggcuacgcaacagaggauuuugacgaucuucuggaaucagacaguauuaccgggcaaaucguguauguagauuugagcucuuacuauauaauugugcgagucuacuucccaauccuaacggagauccagcaggcuuaugugcaggaacugcuccccguuuccuuuaacaacgacaauucagaguggauuagcaucgugccuaacuucguccugauucguaauacucuuauaaguaacaucgaagugaaguacugccugauuaccaaaaagucuguaaucuguaaucaagacuaugccacaccaaugacugcguccguuagagagugcuugacaggaagcaccgauaagugucccagggagcucguggucucgucucacgugccucgguuugcccuguccggcggugucuuauucgcaaacugcaucucagugacgugucagugccagaccacagggcgcgcuauuagucaaagcggagaacagacucugcuaaugauagacaauaccacauguacuaccguugugcucggcaacaucauuaucucccugggcaaauaccuugggucuauuaauuacaacagcgagucaaucgccguaggaccaccggucuauacagauaagguggacauaaguucccagaucagcucuaugaaucagucauugcaacagaguaaagauuacauuaaggaagcucagaaaauccuggacaccguuaaccccagccucauuuccaugcugucuaugaucauacuuuaugugcugucgauugccgcauugugcaucggucucauuacuuuuaucagcuucauaaucgucgagaagaagagaggcaauuacuccaggcuggaugaccgccaggugcggccuguaucaaacggggauuuauauuacauuggaacguga

SEQ ID NO: 1155 - RNA, 1614 nt, Artificial Sequence
  derived and/or modified CDS sequence (opt3) from Hendra henipavirus__AAB39505__H1N1-HA(1-17)_F(27-546)
augaaggccauccuggugguccuccuuuacaccuucgcuacagcaaacgccauacuacacuacgagaaacucuccaagaucggucuggugaaaggcauuacaaggaaguauaaaaucaagucuaacccccuuacuaaggacauuguaaucaaaaugauaccuaaugugucaaacgucaguaagugcacggggaccgugauggaaaauuacaaaagccggcugacaggaaucuuguccccaauuaagggcgcuaucgagcucuauaacaauaacacucaugaucugguuggugacgugaaacuggcaggggucgugauggccggaauugcgaucggcauagcuaccgccgcacaaauuacagccggcguagcucucuacgaagcaaugaagaaugccgauaacaucaauaaguuaaaaucuucgauugagucaaccaacgaggcuguugugaagcugcaggaaacugccgagaaaacagucuaugugcuuaccgcguugcaggacuacaucaauacgaaccuggugccgacuaucgaucagauuagcuguaagcaaaccgaacuagcacucgaccuggcccuuaguaaauaucuguugauaugcuccuguuucgggcccaaucuccaggauccugucucuaacagcaugacaauccaggcuauuucccaggccuuuggagguaauuacgagacucuguuacgcacccugggcuacgcaacagaggacuucgaugaccuccuugaaucagauaguaucaccgggcaaauaguuuauguggaccugagcucuuacuauauuaucguacgaguguacuuuccaaucuugacggagauucagcaggcuuauguccaggaacuacugcccguguccuucaacaacgauaauucagaguggaucagcauuguuccuaacuuugugcucauacguaauacucugaucaguaacauugaagucaaguacugccuuaucacaaagaagucugugaucuguaaucaagacuaugccaccccaaugacugcguccguaagagagugccugacaggaagcaccgacaagugucccagggaguugguugugucgucucacgucccucgguucgcccucuccggcggugugcuguuugcaaacugcauuucagucacgugucagugccagaccacagggcgcgcuauaagucaaagcagagaacagacuuuacugaugaucgauaauaccacaugcacuaccgugguucuaggaaacauuaucauuucccucccaaaauaccugggcucuaucaaacuucagguguugagggcccugcuccugggccaucagagcauacaaacaaaaguagacaucucaagucagauuuccagcaugaaucagucucuucagcaaucaaaggauuacaucaaagaggcucagaagauucuggacaccgucaacccgaguuugaucagcaugcucuccaugauaauucuguauguguuaucuaucgccgcacuguguauugggcuaaucacuuucauaucguuuguuaucguggaaaagaaacggggaaauuacagccgccucgaugaccgacaggucagacccguguccaacggugaucuguauuacauuggcacguga

SEQ ID NO: 1156 - RNA, 1650 nt, Artificial Sequence
  derived and/or modified CDS sequence (opt3) from Nipah henipavirus__AAK50554__H1N1-HA(1-17)_G(70-602)
augaaggccauccuggugguccuccuuuacaccuucgcuacagcaaacgcccagaauuacaccagguccacagauaaccaagccgugauuaaggacgcguuacagggcauccagcagcaaauaaaagggcuggcugauaagauuggaacugaaaucggcccaaaagucucucuaauugacaccucgucaacaaucaccaucccggccaauauuggucuccuggggagcaagauaagucaguccacugcaucuaucaacgagaaugugaacgaaaagugcaaauucacacuucccccucugaagauucacgaguguaauaucagcugcccaaaccccuugccuuuucgggaguaucgcccacagaccgaaggaguuuccaaucucgugggccugcccaacaauauaugucugcagaaaacgucaaaccaaauucucaagccuaaauuaaucaguuacacucugccagucgugggccagagcgggaccugcaucacagauccgcuuuuggccauggacgagggauauuucgcuuacucucaucuggaacgaauugguuccuguucacguggcguaagcaagcagagaaucauugggguuggagaggugcuagauaggggcgacgagguccccagucucuuuaugacuaacguguggaccccuccaaaucccaacacaguguaucacugcucugcagucuacaauaacgaguucuacuauguucugugugccguguccaccguaggugauccuauacuuaauagcacguacuggucggggucucugaugaugacucgguuggcugugaaaccaaaguccaacggaggcggcuauaaucagcaucaacucgcccugcgcucaaucgaaaaggggagauacgacaaagucaugcccuauggaccgagugguauuaagcagggcgauacauuauacuuuccugcggugggguuccugguuaggaccgaauuuaaauauaacgacagcaauugccccaucacuaagugucaguacuccaaaccagagaacugccggcucucuaugggaauccgcccuaauagccacuacauucuucgaucaggccuguugaaguauaaccuaagugacggugaaaaucccaagguggucuucauagagaucuccgaucaaagacugagcauugggucuccaucaaaaaucuacgacagucucggccagcccguguuuuaucaggccagcuucuccugggauacaaugauuaaguuuggagacguacugaccguuaacccucuuguggucaauuggaggaacaacacggugaucucucggccaggccagucgcaauguccgcguuucaauaccugccccgagauaugcugggaaggggucuacaacgaugcauuccugaucgaccgcauuaauuggaucagcgcuggaguguuuuuggauuccaaccagacagccgagaauccuguuuucacuguguuuaaagacaacgaaauucucuauagagcacagcuggcuucagaggauaccaaugcccagaagacaaucacuaacuguuucuuacugaaaaauaagauauggugcauuagucuaguagaaaucuacgacaccggugauaacgucauuaggccaaagcucuuugcggugaaaauccccgagcaauguacauga

SEQ ID NO: 1157 - RNA, 1650 nt, Artificial Sequence
  derived and/or modified CDS sequence (opt3) from Nipah henipavirus__AEZ01389__H1N1-HA(1-17)_G(70-602)
augaaggccauccuggugguccuccuuuacaccuucgcuacagcaaacgcccagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccauucuuaauuccaccuacuggucagguagucugaugaugacgagauuggcugugaagccuaaaaacaauggggaaagcuauaaccagcaucaauuugcccucaggaauauagaaaagggaaaauacgacaaggucaugccauauggccccuccggcaucaaacagggggauacucuguacuucccggcggugggauuuuuaguucggacagaguucaaguauaacgacucuaauugcccuauugcagaaugucaguacagcaagcccgagaacugccgccugucaauggguaucagaccaaauagucacuacauccucagguccggccuucugaaauauaacuugagcgacgaggaaaauucuaagauuguguuuauagagaucucagaucaacggcuaaguauugggagcccuuccaaaaucuacgacucucugggacagcccgucuucuaucaggccucguuuagcugggauaccaugauuaaguucggcgacgugcagacuguaaacccacucguugugaacuggcgcgauaauacagucaucucccgacccggucaaucacaguguccuagauucaacaaaugcccagaagugugcugggagggggucuacaaugacgcuuuucugauagauaggaucaacuggauuagugccggcguguuccuugacucuaaucagaccgcagaaaacccgguuuuuacgguguucaaggauaaugagguacuguaucgggcucaguuggccagcgaggacaccaacgcgcaaaagacaaucacuaauuguuuucuccugaaaaacaagauuuggugcaucuccuuagucgaaauauacgauaccggagacaaugugauucgucccaaacuguucgccguuaagaucccugagcaguguacauga

SEQ ID NO: 1158 - RNA, 1650 nt, Artificial Sequence
  derived and/or modified CDS sequence (opt3) from Nipah henipavirus__ACT32615__H1N1-HA(1-17)_G(70-602)
augaaggccauccuggugguccuccuuuacaccuucgcuacagcaaacgcccagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccgugcuuaauuccaccuacuggucagguagucugaugaugacgagauuggcugucaagccuaaaaacaauggggaaagcuauaaccagcaucaauuugcccucaggaauauugaaaagggaaaauacgacaaggugaugccauauggccccuccggcauaaaacagggggauacucuguacuucccggcgguuggauuuuuagugcggacagaguucaaguauaacgacucuaauugcccuaucgcagaaugucaguacagcaagcccgagaacugccgccugucaauggguauuagaccaaauagucacuacauccucagguccggccuucugaaauauaacuugagcgacgaggaaaauucuaagaucgucuuuauugagauaucagaucaacggcuaaguaucgggagcccuuccaaaauuuacgacucucugggacagcccguguucuaucaggccucguuuagcugggauaccaugaucaaguucggcgacguacagacuguuaacccacucguggucaacuggcgcgauaauacagugauuucccgacccggucaaucacaguguccuagauucaacaaaugcccagaagucugcugggaggggguguacaaugacgcuuuucugaucgauaggauaaacuggaucagugccggcguuuuccuugacucuaaucagaccgcagaaaacccgguguuuacgguauucaaggauaaugagguccuguaucgggcucaguuggccagcgaggacaccaacgcgcaaaagacaauuacuaauuguuuucuccugaaaaacaagaucuggugcauuuccuuaguggaaaucuacgauaccggagacaauguuauacgucccaaacuguucgccgugaagauuccugagcaguguacauga

SEQ ID NO: 1159 - RNA, 1650 nt, Artificial Sequence
  derived and/or modified CDS sequence (opt3) from Nipah henipavirus__CAF25497__H1N1-HA(1-17)_G(70-602)
augaaggccauccuggugguccuccuuuacaccuucgcuacagcaaacgcccagaacuacaccagguccacagauaaucaagccgugaucaaggacgcguuacagggcauucagcagcaaaucaaagggcuggcugauaagauaggaacugaaauuggcccaaaagucucucuaaucgacaccucgucaacaauuaccaucccggccaacaucggucuccuggggagcaagauuagucaguccacugcaucuauaaaugagaacgugaaugaaaagugcaaauucacacuucccccucugaagauccacgaguguaacauuagcugcccaaaucccuugccuuuucgggaguaucgcccacagaccgaaggaguuuccaaccucgugggccugcccaauaacaucugucugcagaaaacgucaaaccaaauacucaagccuaaauuaauuaguuacacucugccagucgugggccagagcgggaccugcaucacagauccgcuuuuggccauggacgagggauauuucgcuuacucucaucuggaacgaaucgguuccuguucacguggcguaagcaagcagagaauuaucgggguuggagaggugcuagauaggggcgacgagguccccagucucuuuaugacuaaugugugggcaccuccaaaccccaauaccguguaucacugcucugccgucuacaacaaugaguucuacuauguucugugugcuguguccacaguaggugauccuauucuuaacagcaccuacuggucggggucucugaugaugacgcgguuggccgugaaaccaaaguccaauggaggcggcuauaaccagcaucaacucgcgcugcgcucaauagaaaaggggagauacgacaaagucaugcccuauggaccgagugguaucaagcagggcgauacuuuauacuuuccugcagugggguuccugguuaggacagaauuuaaauauaaugacagcaacugccccauuaccaagugucaguacuccaaaccagagaauugccggcucucuaugggaauccgcccuaacagccacuacauccuucgaucaggccuguugaaguauaaucuaagugacggugaaaaccccaagguggucuucauugagauauccgaucaaagacugagcaucgggucuccaucaaaaauuuacgacagucucggccagcccguguuuuaucaggccagcuucuccugggauacuaugaucaaguuuggagacguacugacaguuaauccucuuguggucaacuggaggaacaauaccgugauuucucggccaggccagucgcaauguccgcguuucaacacgugccccgagaucugcugggaaggggucuacaaugaugcuuuccugauagaccgcaucaacuggauuagcgccggaguguuuuuggauuccaaucagaccgcagagaacccuguuuucacaguguuuaaagacaaugaaauccucuauagagcucagcuggccucagaggauacuaacgcgcagaagaccauuacaaauuguuucuuacugaaaaacaagaucuggugcauaagucuaguagaaauuuacgacacuggugauaaugucaucaggccaaagcucuuugccgugaaaauucccgagcaauguaccuga

SEQ ID NO: 1160 - RNA, 1650 nt, Artificial Sequence
  derived and/or modified CDS sequence (opt3) from Nipah henipavirus__CBM41034__H1N1-HA(1-17)_G(70-602)
augaaggccauccuggugguccuccuuuacaccuucgcuacagcaaacgcccagaacuacaccagguccacagauaaucaagccgugaucaaggacgcguuacagggcauucagcagcaaaucaaagggcuggcugauaagauaggaacugaaauuggcccaaaagucucucuaaucgacaccucgucaacaauuaccaucccggccaacaucggucuccuggggagcaagauuagucaguccacugcaucuauaaaugagaacgugaaugaaaagugcaaauucacacuucccccucugaagauccacgaguguaacauuagcugcccaaaucccuugccuuuucgggaguaucgcccacagaccgaaggaguuuccaaccucgugggccugcccgauaauaucugucugcagaaaacgucaaaccaaauacucaagccuaaauuaauuaguuacacucugccagucgugggccagagcgggaccugcaucacagacccgcuuuuggccauggaugagggauauuucgcuuacucucaucuggaacgaaucgguuccuguucacguggcguaagcaagcagagaauuaucgggguuggagaggugcuagacaggggcgaugagguccccagucucuuuaugacuaacguguggaccccuccaaaucccaacacaguguaucacugcucugcagucuacaauaacgaguucuacuauguucugugugccguguccaccguaggugacccuauucuuaauagcacguacuggucggggucucugaugaugacucgguuggcugugaaaccaaaguccaacggaggcggcuauaaucagcaucaacucgcccugcgcucaauagaaaaggggagauacgauaaagucaugcccuauggaccgagugguaucaagcagggcgacacauuauacuuuccugcggugggguuccugguuaggaccgaauuuaaauauaacgacagcaauugccccauuacuaagugucaguacuccaaaccagagaacugccggcucucuaugggaauccgcccuaauagccacuacauccuucgaucaggccuguugaaguauaaccuaagugauggugaaaaucccaagauuguguucauagagaucuccgaccaaagacugagcauugggucuccaucaaaagucuacgauagucucggccagcccguguuuuaucaggccagcuucuccugggacacaaugaucaaguuuggagauguacagaccguuaacccucugguggucaauuggagggacaacacggugauuucucggccaggccaaucgcaguguccgcguuucaauaccugccccgagaucugcugggaaggggucuacaacgaugcauuccuuauagaccgcaucaacuggauuagcgcuggaguguuucuggauuccaaucagacagccgagaacccuguuuucacuguguuuaaagacaaugaaaucuuguauagagcacagcucgcuucagaggauaccaacgcccaaaagacaauuacuaauuguuuccugcugaaaaacaagaucuggugcauaaguuuaguagaaauuuacgacaccggugacaaugucaucaggccaaagcuauuugcggugaaaauucccgagcaguguacauga

SEQ ID NO: 1161 - RNA, 1650 nt, Artificial Sequence
  derived and/or modified CDS sequence (opt3) from Nipah henipavirus__AAX51853__H1N1-HA(1-17)_G(70-602)
augaaggccauccuggugguccuccuuuacaccuucgcuacagcaaacgcccagaacuacaccaggucuacagauaaucaagccguaaucaaggacgcguuacagggcauacagcagcaaauuaaagggcuggcugauaagaucggaacugaaauuggcccaaaagugucgcuaaucgacaccucaagcacaaucaccauuccggccaacauaggucuccuggggaguaagaucucccagucuacugcaagcauuaaugagaacgucaaugaaaagugcaaauucacacuucccccucugaagauccacgaguguaacauauccugcccaaaucccuugccuuuucgggaguaucgcccacagaccgaaggagugucaaaccucguuggccugcccaauaacauuugucugcagaaaacgaguaaucaaauccucaagccuaaauuaaucagcuacacucugccaguggucggccagucugggaccugcauuacagauccgcuuuuggccauggacgagggauauuucgcuuacucccaucuggaacgaaucgguucauguagccguggcgugaguaagcagaaaauuauagggguaggagagguucuagauagaggcgacgaggugcccucucucuuuaugacuaacgucuggaccccuccaaaccccaauacaguguaucacugcuccgcaguguacaacaaugaguucuacuauguccugugugccguuagcaccgugggugauccuauccuuaacucgacguacuggucugggucccugaugaugacuagguuggcuguaaagccaaagucaaaugacggaggcuauaaccagcaucaacucgcccugcggaguauugaaaaaggccgcuacgauaaggugaugcccuaugggccgagcggaaucaaacagggugacacauuauacuuuccugcggucggcuuccuggugagaaccgaauuuaaguauaaugacuccaacugccccaucacuaaaugucaguacucuaagccagagaauugcaggcucagcauggggauucggccuaacucacacuacguucuucgcaguggacuguugaaguauaaucuauccgauggcgaaaaccccaaaauaguguucaucgagauuagcgaccaacgacugucuaucgguucaccaaguaagauuuacgauagccucgggcagcccgucuuuuaucaggcauccuucucuugggacacaaugaucaaauuuggcgaugugcagaccguaaauccucugguugugucguggagagacaacacggucauaagcaggccaggacaaucccaguguccgcgguucaauaccugccccgagaucugcugggaaggcguguacaacgaugccuuccuuauugaccguaucaacuggauuucagcuggggucuuucuggauaguaaucagacagccgagaacccuguguucacuguuuuuaaggacaaugaaaucuuguaucgcgcacagcucgcuucugaggauaccaacgcccagaaaacaauaacuaauuguuuccuguuaaagaacaagauuuggugcaucagccugguggaaauuuacgacaccggagacaauguaaucagaccaaaacuauuugcggucaagauacccgagcaauguacauga

SEQ ID NO: 1162 - RNA, 1650 nt, Artificial Sequence
  derived and/or modified CDS sequence (opt3) from Nipah henipavirus__AEZ01397__H1N1-HA(1-17)_G(70-602)
augaaggccauccuggugguccuccuuuacaccuucgcuacagcaaacgcccagaauuacaccaggucuacagauaaccaagccaugaucaaggacgcguuacagucgauucagcagcaaaucaaaggccuggcugauaagauagggacugaaauuggaccaaaagugucacuaaucgacaccagcaguacaauuaccaucccggccaauaucggccuccuggguuccaagauuucucagagcacugcauccauaaacgagaaugucaacgaaaagugcaaauucacacuucccccucugaagauccacgaguguaauauuucaugcccaaaccccuugccuuuucgggaguauaaaccacagaccgaaggggugaguaaucucguuggacugcccaacaauaucugucugcagaagacgagcaaccaaauacucaaaccuaaguuaauuucuuacacucugccaguggucggccaguccgggaccugcaucacagauccgcuuuuggccauggacgagggcuauuucgcuuacucacaucuggagaaaaucggaagcuguagucgcggugugucuaagcagcgaauuaucggcguaggggaaguucuagaucguggagacgaggugcccucccucuuuaugacuaacgucuggaccccuagcaauccaaacacaguguaucacugcucggcaguguacaauaacgaguucuacuauguccugugugccguuucugugguaggcgaucccauucuuaauuccaccuacuggucagguagucugaugaugacgagauuggcugugaagccuaaaaacaauggggaaagcuauaaccagcaucaauuugcccucaggaauauagaaaagggaaaauacgacaaggucaugccauauggccccuccggcaucaaacagggggauacucuguacuucccggcggugggauuuuuaguucggacagaguucaccuauaacgacucuaauugcccuauugcagaaugucaguacagcaagcccgagaacugccgccugucaauggguaucagaccaaauagucacuacauccucagguccggccuucugaaguauaacuugagcgacgaggaaaauucuaaaauuguguuuauagagaucucagaucaacggcuaaguauugggagcccuuccaagaucuacgacucucugggacagcccgucuucuaucaggccucguuuagcugggauacuaugauuaaauucggcgacgugcagacaguaaacccacucguugugaacuggcgcgauaauaccgucaucucccgacccggucaaucacaguguccuagauucaacaagugcccagaagugugcugggagggggucuacaaugacgcuuuucugauagauaggaucaacuggauuagugccggcguguuccuugacucuaaucagacggcagaaaacccgguuuuuaccguguucaaagauaaugagguacuguaucgggcucaguuggccagcgaggacacaaacgcgcaaaagacuaucaccaauuguuuucuccugaagaacaaaauuuggugcaucuccuuagucgaaauauacgauacaggagacaaugugauucgucccaagcuguucgccguuaaaaucccugagcaguguacuuga

SEQ ID NO: 1163 - RNA, 1656 nt, Artificial Sequence
  derived and/or modified CDS sequence (opt3) from Hendra henipavirus__NP_047112__H1N1-HA(1-17)_G(70-604)
augaaggccauccuggugguccuccuuuacaccuucgcuacagcaaacgcccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauagccaucacaaaggucgaaagagggaaauacgauaagguuaugccuuauggaccauccggcauuaaacaaggcgacacccucuacuuucccgcugugggguuccuuccgaggacggaguuucaguauaaugauucuaacugcccuaucauucacuguaaguacagcaaagccgagaauugccggcugucaaugggaguaaacaguaagucccacuauaucuugcgcagcggucuacugaaguacaaucucucucugggcggggacauaauccuucaguucauugaaaucgcggauaaccgacugaccauuggaucacccaguaaaaucuacaauagcuugggccaaccaguguuuuaucaggcauccuacucuugggacacaaugauaaagcucggugaugucgacacuguggauccucugagaguucaguggaggaacaauucggugauuagccggcccgggcagucccaauguccacguuucaacgucugccccgaggugugcugggaaggcaccuauaaugacgccuuuuuaaucgaccgccugaacuggguaucagcuggaguuuaccuaaacaguaaucagacagccgagaacccuguguucgcagucuucaaagauaaugaaauucucuaucaggugccacuggcugaggacgauacuaacgcccagaagaccaucacagacuguuuucuuuuggagaaugucauauggugcaucucucugguggaaauuuacgauaccggcgacagcguuaucagaccgaaacucuucgcggugaagauucccgcccaauguuccgagucauga

SEQ ID NO: 1164 - RNA, 1656 nt, Artificial Sequence
  derived and/or modified CDS sequence (opt3) from Hendra henipavirus__AEB21225__H1N1-HA(1-17)_G(70-604)
augaaggccauccuggugguccuccuuuacaccuucgcuacagcaaacgcccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauagccaucacaaaggucgaaagagggaaauacgauaagguuaugccuuauggaccauccggcauuaaacaaggcgacacccucuacuuucccgcugugggguuccuuccgaggacggaguuucaguauaaugauucuaacugcccuaucauucacuguaaguacagcaaagccgagaauugccggcugucaaugggaguaaacaguaagucccacuauaucuugcgcagcggucuacugaaguacaaucucucucugggcggggacauaacccuucaguucaucgaaauugcggauaaccgacugacaaucggaucacccaguaaaauuuacaauagcuugggccaaccaguguuuuaucaggcauccuacucuugggacacuaugaucaagcucggugaugucgacaccguggauccucugagaguucaguggaggaacaauucggugauaagccggcccgggcagucccaauguccacguuucaacgucugccccgaggugugcugggaaggcacauauaaugacgccuuuuuaauugaccgccugaacuggguaucagcuggaguuuaccuaaacaguaaucagacugccgagaacccuguguucgcagucuucaaagauaaugaaauccucuaucaggugccacuggcugaggacgauaccaacgcccagaagacaauuaccgacuguuuucuuuuggagaaugucaucuggugcauaucucugguggaaaucuacgauacuggcgacagcguuauuagaccgaaacucuucgcggugaagauccccgcccaauguuccgagucauga

SEQ ID NO: 1165 - RNA, 1656 nt, Artificial Sequence
  derived and/or modified CDS sequence (opt3) from Hendra henipavirus__AEB21216__H1N1-HA(1-17)_G(70-604)
augaaggccauccuggugguccuccuuuacaccuucgcuacagcaaacgcccaaaauuacacuagaacgaccgauaaccaggcccuaaucaaagagagccuccaguccguacagcaacagauaaaggcgcugacagacaaaauuggaacugaaaucggcccuaaggugucucuuauugauaccucgucaacaaucaccaucccagcuaauauuggucuguuggggagcaaaauaagucaguccacuucuagcaucaacgagaaugucaacgacaagugcaaguuuacacucccgccccugaaaauucacgaauguaauaucuccugcccuaacccacugcccuucagggaguaucggccuauaucacagggagugagugaucucguuggcuuaccaaaucaaauuugucugcagaagaccacgagcacuauccuuaaaccccgcuugaucucuuacacccugccuauuaacacacgagaaggcgugugcaucacugacccacuacucgccgucgauaacggguuuuucgcauauucccaucuggagaagauuggaucauguacccgugguauagccaaacagagaaucauuggcgugggggagguacuugacaggggagauaagguuccgagcauguuuaugacaaauguguggacgcccccuaacccaaguaccauccaccauuguucuuccacuuaccacgaagacuucuauuacacacugugcgcugucagccaugugggcgaccccauccucaauucgaccucuuggacugaguccuugucacugauucgguuagcagugcgcccuaaaagugauagcggugacuacaaccagaaguauauagccaucaauaaggucgaaagagggaaauacgauaagguuaugccauauggacccuccggcauuaaacaaggcgacacacuguacuuuccggcugugggguuccucccuaggaccgaguuucaguauaacgauucuaauugccccaucauucacuguaaguacagcaaagccgagaacugccggcuuucaaugggaguaaauaguaagucccacuauauccugcgcagcgguuugcuaaaguacaaccugucucucggcggggacauaauccugcaguucauugaaaucgcggauaaucgacuuacgauuggaucaccaaguaaaaucuacaacagccugggccaaccuguguuuuaucaggcauccuacucuugggacaccaugauaaaguugggugaugucgacacaguggauccccucagaguucaguggaggaauaacucggugauuagccggccagggcagucccaauguccccguuucaaugucugcccugaggugugcugggaaggcacuuauaacgacgccuuucugaucgaccgcuuaaacuggguaucagcuggaguuuaccugaauaguaaccagaccgccgagaauccaguguucgcagucuucaaagauaacgaaauucuauaucaggugccgcucgcugaggacgauacaaaugcccagaagacuaucaccgacuguuuucugcuugagaacgucauauggugcaucucuuugguggaaauuuacgauacaggcgacagcguuaucagacccaaacuguucgcggugaagauuccugcccaauguuccgagucauga

SEQ ID NO: 1166 - RNA, 1656 nt, Artificial Sequence
  derived and/or modified CDS sequence (opt3) from Hendra henipavirus__AEB21206__H1N1-HA(1-17)_G(70-604)
augaaggccauccuggugguccuccuuuacaccuucgcuacagcaaacgcccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcgguaacuacaaucagaaguauauagccaucacaaaggucgaaagagggaaauacgacaagguuaugccuuauggaccauccggcauuaaacaaggcgauacccucuacuuucccgcugugggguuccuuccgaggacggaguuucaguauaacgacucuaauugcccuaucauucacuguaaguacagcaaagccgagaacugccggcugucaaugggaguaaauaguaagucccacuauaucuugcgcagcggucuacugaaguacaaccucucucugggcggggauauaauccuucaguucauugaaaucgcggacaaucgacugaccauuggaucacccaguaaaaucuacaacagcuugggccaaccaguguuuuaucaggcauccuacucuugggauacaaugauaaagcucggugacauugauacugucgacccucugagagugcaguggaggaauaacucgguuaucagccggcccgggcagucccaauguccacguuucaaugugugccccgaggucugcugggaaggcaccuauaacgaugccuuuuuaauugaccgccugaacugggugucagcuggaguauaccuaaauaguaaccagacagccgagaauccuguuuucgcaguguucaaagacaacgaaauccucuaucaggucccacuggcugaggaugacacuaaugcccagaagaccauaacagauuguuuucuuuuggagaacgugaucuggugcauuucucuggucgaaaucuacgacaccggcgauagcgugauuagaccgaaacucuucgcgguuaagauccccgcccaauguuccgagucauga

SEQ ID NO: 1167 - RNA, 1656 nt, Artificial Sequence
  derived and/or modified CDS sequence (opt3) from Hendra henipavirus__AEQ38052__H1N1-HA(1-17)_G(70-604)
augaaggccauccuggugguccuccuuuacaccuucgcuacagcaaacgcccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauaacaaucaccaaggucgaaagagggaaauacgauaagguuaugccuuauggaccauccggcauuaaacaaggcgacacgcucuacuuucccgccgugggguuccuuccgaggaccgaguuucaguauaaugauucuaacugcccuaucauucacuguaaguacagcaaagcugagaauugccggcugucaaugggaguaaacaguaagucccacuauaucuugcgcagcggucuacugaaguacaaucucucucugggcggggacauaauccuucaguucauugaaaucgccgauaaccgacugacaauuggaucacccaguaaaaucuacaauagcuugggccaaccaguguuuuaucaggcguccuacucuugggacacuaugauaaagcucggugaugucgacaccguggauccucugagaguucaguggaggaacaauucggugauuagccggcccgggcagucccaauguccacguuucaacgucugccccgaggugugcugggaaggcacauauaaugacgcauuuuuaaucgaccgccugaacuggguaucagccggaguuuaccuaaacaguaaucagacugcugagaacccuguguucgccgucuucaaagauaaugaaauucucuaucaggugccacuggcagaggacgauaccaacgcucagaagacaaucaccgacuguuuucuuuuggagaaugucauauggugcaucucucugguggaaauuuacgauacuggcgacagcguuaucagaccgaaacucuucgccgugaagauucccgcgcaauguuccgagucauga

SEQ ID NO: 1168 - RNA, 1656 nt, Artificial Sequence
  derived and/or modified CDS sequence (opt3) from Hendra henipavirus__AEQ38115__H1N1-HA(1-17)_G(70-604)
augaaggccauccuggugguccuccuuuacaccuucgcuacagcaaacgcccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauaacggugacuacaaucagaaguauauagccaucacaaaggucgaaagagggaaauacgauaagguuaugccuuauggaccaagcggcauuaaacaaggcgacacccucuacuuucccgcugugggguuccuuccgaggacggaguuucaguauaacgauuccaauugcccuaucauucacuguaaguacucuaaagccgagaacugccggcugagcaugggaguaaauucaaagagucacuauaucuugcgcuccggucuacugaaguacaaccucagccugggcggggacauaauccuucaguucauugaaaucgcggauaaucgacugaccauuggaucucccucaaaaaucuacaacaguuugggccaaccaguguuuuaucaggcaagcuacuccugggacacaaugauaaagcucggugaugucgacacuguggauccucugagaguucaguggaggaauaacucugugauuucgcggcccgggcagagccaauguccacguuucaaugucugccccgaggugugcugggaaggcaccuauaacgacgccuuuuuaaucgaccgccugaacuggguauccgcuggaguuuaccuaaauucaaaccagacagccgagaauccuguguucgcagucuucaaagauaacgaaauucucuaucaggugccacuggcugaggacgauacuaaugcccagaagaccaucacagacuguuuucuuuuggagaacgucauauggugcaucagucugguggaaauuuacgauaccggcgacucuguuaucagaccgaaacucuucgcggugaagauucccgcccaauguagcgaguccuga

SEQ ID NO: 1169 - RNA, 1656 nt, Artificial Sequence
  derived and/or modified CDS sequence (opt3) from Hendra henipavirus__AEQ38108__H1N1-HA(1-17)_G(70-604)
augaaggccauccuggugguccuccuuuacaccuucgcuacagcaaacgcccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucaguccacuucuagcaucaacgagaaugucaacgacaagugcaaguuuacacugccaccgcugaaaauucacgaauguaauaucuccugccccaacccucucccauucagggaguaucggcccauaucacagggagugagugauuuaguuggccugccuaaucaaauuugucuucagaagaccacgagcacuaucuugaaaccacgccugaucucuuacacccuacccauuaacacacgagaaggcgugugcaucacugacccucuccuggccgucgauaacggguuuuucgcauauucccaucuugagaagauuggaucauguacccgugguauagccaaacagagaaucauuggcgugggggagguacuggacaggggagauaagguuccaagcauguuuaugacaaauguguggaccccgcccaacccuaguacgauccaccauuguucuuccacuuaccacgaagacuucuauuacacauugugcgcugucagccaugugggcgacccaauccucaauucgaccucuuggacugagucccugucauuaauucggcuggcagugcgccccaaaagugauagcggugacuacaaccagaaguauauaacaaucaccaaggucgaaagagggaaauacgauaagguuaugccuuauggaccauccggcauuaaacaaggcaauacgcucuacuuucccgccgugggguuccuuccgaggaccgaguuucaguauaacgacucuaauugcccuaucauucacuguaaguacagcaaagcugagaacugccggcugucaaugggaguaaauaguaagucccacuauaucuugcgcagcggucuacugaaguacaaccucucucugggcggggauauaauccuucaguucauugaaaucgccgacaaucgacugacaauuggaucacccaguaaaaucuacaacagcuugggccaaccaguguuuuaucaggcguccuacucuugggauacuaugauaaagcucggugacgucgauaccguggacccucugagaguucaguggaggaauaacucggugauuagccggcccgggcagucccaauguccacguuucaaugucugccccgaggugugcugggaaggcacauauaacgaugcauuuuuaaucgaccgccugaacuggguaucagccggaguuuaccuaaauaguaaccagacugcugagaauccuguguucgccgucuucaaagacaacgaaauucucuaucaggugccacuggcagaggaugacaccaaugcucagaagacaaucaccgauuguuuucuuuuggagaacgucauauggugcaucucucugguggaaauuuacgacacuggcgauagcguuaucagaccgaaacucuucgccgugaagauucccgcgcaauguuccgagucauga

SEQ ID NO: 1170 - RNA, 1656 nt, Artificial Sequence
  derived and/or modified CDS sequence (opt3) from Hendra henipavirus__AAV80426__H1N1-HA(1-17)_G(70-604)
augaaggccauccuggugguccuccuuuacaccuucgcuacagcaaacgcccaaaauuacacuagaacgaccgauaaccaggcccucaucaaagagagccugcaguccguacagcaacagauaaaggcgcuuacagacaaaauuggaacugaaaucggccccaaggugucucugauugauaccucgucaacaaucaccaucccugcuaauauugguuugcucgggagcaaaauaagucagugcacuuccucuaucaacgagaaugucaacgacaaguguaaguuuacacugccaccgcugaaaauucacgaaugcaauaucagcugucccaacccucucccauucagggaguaucggcccauaucccagggagugucagauuuaguuggccugccuaaucaaauuugccuucagaagaccacgaguacuaucuugaaaccacgccugaucagcuacacccuacccauuaacacacgagaaggcguguguaucacugacccucuccuggccgucgauaacggguuuuucgcauauucucaucuugagaagauuggauccugcacccgugguauagccaaacagagaaucauuggcgugggggagguacuggacaggggagauaagguuccaucaauguuuaugacaaauguguggaccccgcccaacccuagcacgauccaccauuguaguucuacuuaccacgaagacuucuauuacacauugugcgcugucucccaugugggcgacccaauccucaauagcaccucguggacugagucucuguccuuaauucggcuggcagugcgccccaaaucagauaguggugacuacaaccagaaguauauagccaucacaaaggucgaaagagggaaauacgauaagguuaugccuuauggaccaagcggcauuaaacaaggcgacacccucuacuuucccgcugugggguuccuuccgaggacggaguuucaguauaaugauuccaacuguccuaucauucacugcaaguacucuaaagccgagaauugucggcugagcaugggaguaaacucaaagagucacuauaucuugcgcuccggucuacugaaguacaaucucagccugggcggggacauaauccuucaguucauugaaaucgcggauaaccgacugaccauuggaucucccucaaaaaucuacaauaguuugggccaaccaguguuuuaucaggcaagcuacuccugggacacaaugauaaagcucggugaugucgacacuguggauccucugagaguucaguggaggaacaauucugugauuucgcggcccgggcagagccaaugcccacguuucaacgucugccccgagguguguugggaaggcuccuauaaugacgccuuuuuaaucgaccgccugaacuggguaucagcuggaguuuaccuaaacaguaaucagaccgccgagaacccuguguucgcagucuucaaagauaaugaaauucucuaucaggugccacuggcugaggacgauacaaacgcccagaagacuaucaccgacugcuuucuuuuggagaaugucauaugguguaucucucugguggaaauuuacgauacaggcgacagcguuaucagaccgaaacucuucgcggugaagauucccgcccaaugcuccgagucauga

SEQ ID NO: 1171 - RNA, 1614 nt, Artificial Sequence
  derived and/or modified CDS sequence (opt4) from Nipah henipavirus__AAK50553__H1N1-HA(1-17)_F(27-546)
augaaggccauccugguggugcugcuguacaccuucgccaccgccaacgccauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1172 - RNA, 1614 nt, Artificial Sequence
  derived and/or modified CDS sequence (opt4) from Nipah henipavirus__AEZ01388__H1N1-HA(1-17)_F(27-546)
augaaggccauccugguggugcugcuguacaccuucgccaccgccaacgccauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1173 - RNA, 1614 nt, Artificial Sequence
  derived and/or modified CDS sequence (opt4) from Nipah henipavirus__AAY43915__H1N1-HA(1-17)_F(27-546)
augaaggccauccugguggugcugcuguacaccuucgccaccgccaacgccauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguacagcagcgaccugcuguucguguucggccccaaccugcaggaccccgugagcaacagcaugaccauccaggccaucagccaggccuucggcggcaacuacgagacccugcugagaacccugggcuacgccaccgagggcuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1174 - RNA, 1614 nt, Artificial Sequence
  derived and/or modified CDS sequence (opt4) from Nipah henipavirus__CAF25496__H1N1-HA(1-17)_F(27-546)
augaaggccauccugguggugcugcuguacaccuucgccaccgccaacgccauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaucgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1175 - RNA, 1614 nt, Artificial Sequence
  derived and/or modified CDS sequence (opt4) from Nipah henipavirus__AAM13405__H1N1-HA(1-17)_F(27-546)
augaaggccauccugguggugcugcuguacaccuucgccaccgccaacgccauccugcacuacgagaagcugagcaagaucggccuggugaagggcgugaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaccaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1176 - RNA, 1614 nt, Artificial Sequence
  derived and/or modified CDS sequence (opt4) from Nipah henipavirus__CBM41033__H1N1-HA(1-17)_F(27-546)
augaaggccauccugguggugcugcuguacaccuucgccaccgccaacgccauccugcacuacgagaagcugagcaagaucggccuggugaagggcgugaccagaaaguacaagaucaagagcaacccccugaccaaggacaucgugaucaagaugaucgccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucaucuacguggaccugagcagcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaagagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1177 - RNA, 1614 nt, Artificial Sequence; identical to SEQ ID NO: 1172
  derived and/or modified CDS sequence (opt4) from Nipah henipavirus__AEZ01396__H1N1-HA(1-17)_F(27-546)

SEQ ID NO: 1178 - RNA, 1614 nt, Artificial Sequence
  derived and/or modified CDS sequence (opt4) from Hendra henipavirus__NP_047111__H1N1-HA(1-17)_F(27-546)
augaaggccauccugguggugcugcuguacaccuucgccaccgccaacgccauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucgccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 1179 - RNA, 1614 nt, Artificial Sequence
  derived and/or modified CDS sequence (opt4) from Hendra henipavirus__AEB21233__H1N1-HA(1-17)_F(27-546)
augaaggccauccugguggugcugcuguacaccuucgccaccgccaacgccauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 1180 - RNA, 1617 nt, Artificial Sequence
  derived and/or modified CDS sequence (opt4) from Hendra henipavirus__AEQ38114__H1N1-HA(1-17)_F(26-546)
augaaggccauccugguggugcugcuguacaccuucgccaccgccaacgccggcauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugagcgaccugcuguucguguucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcggcgagcagacccugcugaugaucgacaacaccaccugcaccaccguggugcugggcaacaucaucaucagccugggcaaguaccugggcagcaucaacuacaacagcgagagcaucgccgugggcccccccguguacaccgacaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucaucaucguggagaagaagagaggcaacuacagcagacuggacgacagacaggugagacccgugagcaacggcgaccuguacuacaucggcaccuga

SEQ ID NO: 1181 - RNA, 1614 nt, Artificial Sequence
  derived and/or modified CDS sequence (opt4) from Hendra henipavirus__AAB39505__H1N1-HA(1-17)_F(27-546)
augaaggccauccugguggugcugcuguacaccuucgccaccgccaacgccauccugcacuacgagaagcugagcaagaucggccuggugaagggcaucaccagaaaguacaagaucaagagcaacccccugaccaaggacaucgugaucaagaugauccccaacgugagcaacgugagcaagugcaccggcaccgugauggagaacuacaagagcagacugaccggcauccugagccccaucaagggcgccaucgagcuguacaacaacaacacccacgaccuggugggcgacgugaagcuggccggcguggugauggccggcaucgccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgaccagaucagcugcaagcagaccgagcuggcccuggaccuggcccugagcaaguaccugcugaucugcagcugcuucggccccaaccugcaggaccccgugagcaacagcaugaccauccaggccaucagccaggccuucggcggcaacuacgagacccugcugagaacccugggcuacgccaccgaggacuucgacgaccugcuggagagcgacagcaucaccggccagaucguguacguggaccugagcagcuacuacaucaucgugagaguguacuuccccauccugaccgagauccagcaggccuacgugcaggagcugcugcccgugagcuucaacaacgacaacagcgaguggaucagcaucgugcccaacuucgugcugaucagaaacacccugaucagcaacaucgaggugaaguacugccugaucaccaagaagagcgugaucugcaaccaggacuacgccacccccaugaccgccagcgugagagagugccugaccggcagcaccgacaagugccccagagagcugguggugagcagccacgugcccagauucgcccugagcggcggcgugcuguucgccaacugcaucagcgugaccugccagugccagaccaccggcagagccaucagccagagcagagagcagacccugcugaugaucgacaacaccaccugcaccaccguggugcugggcaacaucaucaucagccugcccaaguaccugggcagcaucaagcugcaggugcugagagcccugcugcugggccaccagagcauccagaccaagguggacaucagcagccagaucagcagcaugaaccagagccugcagcagagcaaggacuacaucaaggaggcccagaagauccuggacaccgugaaccccagccugaucagcaugcugagcaugaucauccuguacgugcugagcaucgccgcccugugcaucggccugaucaccuucaucagcuucgugaucguggagaagaagagaggcaacuacagcagacuggacgacagacaggugagacccgugagcaacggcgaccuguacuacaucggcaccuga

SEQ ID NO: 1182 - RNA, 1650 nt, Artificial Sequence
  derived and/or modified CDS sequence (opt4) from Nipah henipavirus__AAK50554__H1N1-HA(1-17)_G(70-602)
augaaggccauccugguggugcugcuguacaccuucgccaccgccaacgcccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaaggugguguucaucgagaucagcgaccagagacugagcaucggcagccccagcaagaucuacgacagccugggccagcccguguucuaccaggccagcuucagcugggacaccaugaucaaguucggcgacgugcugaccgugaacccccugguggugaacuggagaaacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 1183 - RNA, 1650 nt, Artificial Sequence
  derived and/or modified CDS sequence (opt4) from Nipah henipavirus__AEZ01389__H1N1-HA(1-17)_G(70-602)
augaaggccauccugguggugcugcuguacaccuucgccaccgccaacgcccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccauccugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaaguacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 1184 - RNA, 1650 nt, Artificial Sequence
  derived and/or modified CDS sequence (opt4) from Nipah henipavirus__ACT32615__H1N1-HA(1-17)_G(70-602)
augaaggccauccugguggugcugcuguacaccuucgccaccgccaacgcccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccgugcugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaaguacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 1185 - RNA, 1650 nt, Artificial Sequence
  derived and/or modified CDS sequence (opt4) from Nipah henipavirus__CAF25497__H1N1-HA(1-17)_G(70-602)
augaaggccauccugguggugcugcuguacaccuucgccaccgccaacgcccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacgugugggccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaaggugguguucaucgagaucagcgaccagagacugagcaucggcagccccagcaagaucuacgacagccugggccagcccguguucuaccaggccagcuucagcugggacaccaugaucaaguucggcgacgugcugaccgugaacccccugguggugaacuggagaaacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 1186 - RNA, 1650 nt, Artificial Sequence
  derived and/or modified CDS sequence (opt4) from Nipah henipavirus__CBM41034__H1N1-HA(1-17)_G(70-602)
augaaggccauccugguggugcugcuguacaccuucgccaccgccaacgcccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccgacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagagaaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacggcggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacauccugagaagcggccugcugaaguacaaccugagcgacggcgagaaccccaagaucguguucaucgagaucagcgaccagagacugagcaucggcagccccagcaagguguacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 1187 - RNA, 1650 nt, Artificial Sequence
  derived and/or modified CDS sequence (opt4) from Nipah henipavirus__AAX51853__H1N1-HA(1-17)_G(70-602)
augaaggccauccugguggugcugcuguacaccuucgccaccgccaacgcccagaacuacaccagaagcaccgacaaccaggccgugaucaaggacgcccugcagggcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacagaccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagagaaucggcagcugcagcagaggcgugagcaagcagaagaucaucggcgugggcgaggugcuggacagaggcgacgaggugcccagccuguucaugaccaacguguggaccccccccaaccccaacaccguguaccacugcagcgccguguacaacaacgaguucuacuacgugcugugcgccgugagcaccgugggcgaccccauccugaacagcaccuacuggagcggcagccugaugaugaccagacuggccgugaagcccaagagcaacgacggcggcuacaaccagcaccagcuggcccugagaagcaucgagaagggcagauacgacaaggugaugcccuacggccccagcggcaucaagcagggcgacacccuguacuuccccgccgugggcuuccuggugagaaccgaguucaaguacaacgacagcaacugccccaucaccaagugccaguacagcaagcccgagaacugcagacugagcaugggcaucagacccaacagccacuacgugcugagaagcggccugcugaaguacaaccugagcgacggcgagaaccccaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugagcuggagagacaacaccgugaucagcagacccggccagagccagugccccagauucaacaccugccccgagaucugcugggagggcguguacaacgacgccuuccugaucgacagaaucaacuggaucagcgccggcguguuccuggacagcaaccagaccgccgagaaccccguguucaccguguucaaggacaacgagauccuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 1188 - RNA, 1650 nt, Artificial Sequence
  derived and/or modified CDS sequence (opt4) from Nipah henipavirus__AEZ01397__H1N1-HA(1-17)_G(70-602)
augaaggccauccugguggugcugcuguacaccuucgccaccgccaacgcccagaacuacaccagaagcaccgacaaccaggccaugaucaaggacgcccugcagagcauccagcagcagaucaagggccuggccgacaagaucggcaccgagaucggccccaaggugagccugaucgacaccagcagcaccaucaccauccccgccaacaucggccugcugggcagcaagaucagccagagcaccgccagcaucaacgagaacgugaacgagaagugcaaguucacccugcccccccugaagauccacgagugcaacaucagcugccccaacccccugcccuucagagaguacaagccccagaccgagggcgugagcaaccuggugggccugcccaacaacaucugccugcagaagaccagcaaccagauccugaagcccaagcugaucagcuacacccugcccguggugggccagagcggcaccugcaucaccgacccccugcuggccauggacgagggcuacuucgccuacagccaccuggagaagaucggcagcugcagcagaggcgugagcaagcagagaaucaucggcgugggcgaggugcuggacagaggcgacgaggugcccagccuguucaugaccaacguguggacccccagcaaccccaacaccguguaccacugcagcgccguguacaacaacgaguucuacuacgugcugugcgccgugagcguggugggcgaccccauccugaacagcaccuacuggagcggcagccugaugaugaccagacuggccgugaagcccaagaacaacggcgagagcuacaaccagcaccaguucgcccugagaaacaucgagaagggcaaguacgacaaggugaugcccuacggccccagcggcaucaagcagggcgacacccuguacuuccccgccgugggcuuccuggugagaaccgaguucaccuacaacgacagcaacugccccaucgccgagugccaguacagcaagcccgagaacugcagacugagcaugggcaucagacccaacagccacuacauccugagaagcggccugcugaaguacaaccugagcgacgaggagaacagcaagaucguguucaucgagaucagcgaccagagacugagcaucggcagccccagcaagaucuacgacagccugggccagcccguguucuaccaggccagcuucagcugggacaccaugaucaaguucggcgacgugcagaccgugaacccccugguggugaacuggagagacaacaccgugaucagcagacccggccagagccagugccccagauucaacaagugccccgaggugugcugggagggcguguacaacgacgccuuccugaucgacagaaucaacuggaucagcgccggcguguuccuggacagcaaccagaccgccgagaaccccguguucaccguguucaaggacaacgaggugcuguacagagcccagcuggccagcgaggacaccaacgcccagaagaccaucaccaacugcuuccugcugaagaacaagaucuggugcaucagccugguggagaucuacgacaccggcgacaacgugaucagacccaagcuguucgccgugaagauccccgagcagugcaccuga

SEQ ID NO: 1189 - RNA, 1656 nt, Artificial Sequence
  derived and/or modified CDS sequence (opt4) from Hendra henipavirus__NP_047112__H1N1-HA(1-17)_G(70-604)
augaaggccauccugguggugcugcuguacaccuucgccaccgccaacgcccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 1190 - RNA, 1656 nt, Artificial Sequence
  derived and/or modified CDS sequence (opt4) from Hendra henipavirus__AEB21225__H1N1-HA(1-17)_G(70-604)
augaaggccauccugguggugcugcuguacaccuucgccaccgccaacgcccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucacccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 1191 - RNA, 1656 nt, Artificial Sequence
  derived and/or modified CDS sequence (opt4) from Hendra henipavirus__AEB21216__H1N1-HA(1-17)_G(70-604)
augaaggccauccugguggugcugcuguacaccuucgccaccgccaacgcccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaacaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 1192 - RNA, 1656 nt, Artificial Sequence
  derived and/or modified CDS sequence (opt4) from Hendra henipavirus__AEB21206__H1N1-HA(1-17)_G(70-604)
augaaggccauccugguggugcugcuguacaccuucgccaccgccaacgcccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcaacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacaucgacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 1193 - RNA, 1656 nt, Artificial Sequence
  derived and/or modified CDS sequence (opt4) from Hendra henipavirus__AEQ38052__H1N1-HA(1-17)_G(70-604)
augaaggccauccugguggugcugcuguacaccuucgccaccgccaacgcccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucaccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 1194 - RNA, 1656 nt, Artificial Sequence
  derived and/or modified CDS sequence (opt4) from Hendra henipavirus__AEQ38115__H1N1-HA(1-17)_G(70-604)
augaaggccauccugguggugcugcuguacaccuucgccaccgccaacgcccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacaacggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 1195 - RNA, 1656 nt, Artificial Sequence
  derived and/or modified CDS sequence (opt4) from Hendra henipavirus__AEQ38108__H1N1-HA(1-17)_G(70-604)
augaaggccauccugguggugcugcuguacaccuucgccaccgccaacgcccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagagcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucaccaucaccaagguggagagaggcaaguacgacaaggugaugcccuacggccccagcggcaucaagcagggcaacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcaccuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 1196 - RNA, 1656 nt, Artificial Sequence
  derived and/or modified CDS sequence (opt4) from Hendra henipavirus__AAV80426__H1N1-HA(1-17)_G(70-604)
augaaggccauccugguggugcugcuguacaccuucgccaccgccaacgcccagaacuacaccagaaccaccgacaaccaggcccugaucaaggagagccugcagagcgugcagcagcagaucaaggcccugaccgacaagaucggcaccgagaucggccccaaggugagccugaucgacaccagcagcaccaucaccauccccgccaacaucggccugcugggcagcaagaucagccagugcaccagcagcaucaacgagaacgugaacgacaagugcaaguucacccugcccccccugaagauccacgagugcaacaucagcugccccaacccccugcccuucagagaguacagacccaucagccagggcgugagcgaccuggugggccugcccaaccagaucugccugcagaagaccaccagcaccauccugaagcccagacugaucagcuacacccugcccaucaacaccagagagggcgugugcaucaccgacccccugcuggccguggacaacggcuucuucgccuacagccaccuggagaagaucggcagcugcaccagaggcaucgccaagcagagaaucaucggcgugggcgaggugcuggacagaggcgacaaggugcccagcauguucaugaccaacguguggaccccccccaaccccagcaccauccaccacugcagcagcaccuaccacgaggacuucuacuacacccugugcgccgugagccacgugggcgaccccauccugaacagcaccagcuggaccgagagccugagccugaucagacuggccgugagacccaagagcgacagcggcgacuacaaccagaaguacaucgccaucaccaagguggagagaggcaaguacgacaaggugaugcccuacggccccagcggcaucaagcagggcgacacccuguacuuccccgccgugggcuuccugcccagaaccgaguuccaguacaacgacagcaacugccccaucauccacugcaaguacagcaaggccgagaacugcagacugagcaugggcgugaacagcaagagccacuacauccugagaagcggccugcugaaguacaaccugagccugggcggcgacaucauccugcaguucaucgagaucgccgacaacagacugaccaucggcagccccagcaagaucuacaacagccugggccagcccguguucuaccaggccagcuacagcugggacaccaugaucaagcugggcgacguggacaccguggacccccugagagugcaguggagaaacaacagcgugaucagcagacccggccagagccagugccccagauucaacgugugccccgaggugugcugggagggcagcuacaacgacgccuuccugaucgacagacugaacugggugagcgccggcguguaccugaacagcaaccagaccgccgagaaccccguguucgccguguucaaggacaacgagauccuguaccaggugccccuggccgaggacgacaccaacgcccagaagaccaucaccgacugcuuccugcuggagaacgugaucuggugcaucagccugguggagaucuacgacaccggcgacagcgugaucagacccaagcuguucgccgugaagauccccgcccagugcagcgagagcuga

SEQ ID NO: 1197 - RNA, 1614 nt, Artificial Sequence
  derived and/or modified CDS sequence (opt5) from Nipah henipavirus__AAK50553__H1N1-HA(1-17)_F(27-546)
augaaggccauccuggugguccuccuguacaccuucgcuacagccaacgcgauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgaccgaggacuuugaugaccuccuggagagcgauucuauuacaggacagaucauuuacgucgaccuguccagcuauuacaucauugugcgcguuuauuucccuauccucaccgaaauccaacaggccuacauucaggagcugcuucccguguccuuuaacaaugacaacucugaauggaucagcauugucccuaauuucauccuggugagaaacacccucauuuccaauaucgagauuggcuuuugucugaucacaaagcggagcguuaucugcaaccaggauuaugcuacgccgaugaccaauaacaugcgcgaaugucuuacagggucuaccgagaaaugccccagagagcugguggucuccagccacgugccucgguucgcccucucuaauggaguccuguuugcuaacuguauuagcgugacaugccaaugucagaccacgggccgcgccaucucccagucuggcgaacaaacacugcucaugauugacaauacaaccugccccaccgccguucuggggaacgugaucauuagccuuggaaaguaccugggcuccgucaauuacaacagcgaggggaucgcuaucggaccucccguguucaccgauaagguugacauuucuucccagaucagcucuaugaaucagucccuccagcaaagcaaagauuauauuaaggaagcgcagagacugcuggacacagugaacccgucccuuaucucuaugcucagcaugauuauccuguacguccuguccaucgccucucucugcauuggccugaucacguuuauuagcuucaucauuguggagaaaaagcggaacaccuauucccgccuugaagauagacgggugcgcccuacaagcucuggggaccuguacuauaucggaaccuga

SEQ ID NO: 1198 - RNA, 1614 nt, Artificial Sequence
  derived and/or modified CDS sequence (opt5) from Nipah henipavirus__AEZ01388__H1N1-HA(1-17)_F(27-546)
augaaggccauccuggugguccuccuguacaccuucgcuacagccaacgcgauucuccacuacgaaaaacugagcaagaucgggcuuguuaaaggaaucacccggaaguauaaaauuaaguccaacccccugacaaaggacaucgugauuaaaaugaucccuaaugugucuaacaugagccaguguacgggcuccgucauggagaauuacaagacccgccucaacgggauucugacaccgaucaaaggagcucuggaaauuuauaagaauaacacccaugaucucgugggcgacguuagacuggccggggugaucauggcgggagucgcuaucggcauugccacagccgcucaaaucaccgccggcguggcucuuuacgaggccaugaaaaaugcggauaacauuaauaagcugaagucuagcaucgaauccacaaacgaggccguugugaaacuccaggagaccgcugaaaagacggucuaugugcugaccgcccuucaggacuacauuaauacaaaccuggugcccaccaucgauaaaaucagcugcaagcagacagagcucucucuggaccuggcucucuccaaauaccugagcgaucuucuguucgucuuugggccuaaucuccaagaccccguuucuaacuccaugaccauucaggccaucagccaggcguucggaggcaacuaugaaacgcugcuucggacacugggguacgccaccgaggauuuugacgaucuccuggagucugacuccauuacaggacagaucauuuauguggaucugagcggcuacuauaucaucgugcgcgucuacuucccuauucucaccgaaauccaacaggcuuauauucaggagcugcuucccguguccuuuaauaacgacaauucugaauggaucagcauuguuccuaacuucauccuggugagaaauacccucauuuccaacaucgagaucggguuuugucugauuacaaagcggagcgucaucugcaaucaggacuacgccacgccgaugaccaacaauaugcgcgaaugucuuacaggaucuaccgagaaaugccccagagagcuggugguuuccagccacgugccucgguucgcucucucuaacggcguccuguuugccaauuguauuagcgugacaugccaaugucagaccacgggccgcgccaucucccagucuggggaacaaacacugcucaugauugauaacacaaccugccccaccgcuguccugggaaaugugaucaucagccuuggcaaguaccugggguccguuaacuauaauagcgagggaauugcgaucggcccucccguguucaccgacaaggucgauauuucuucccagaucagcucuaugaaccagucccuccagcaaagcaaagacuacauuaaggaagcccagagacugcuggauacagugaacccgucccuuaucucuaugcucagcaugaucauucuguauguucuguccaucgcuucucucuguauugggcugaucacguuuauuagcuucaucaucguggagaaaaagcggaauaccuacucccgccuugaagacagacggguccgcccuacaagcucuggagaucuguauuacauuggcaccuga

SEQ ID NO: 1199 - RNA, 1614 nt, Artificial Sequence
  derived and/or modified CDS sequence (opt5) from Nipah henipavirus__AAY43915__H1N1-HA(1-17)_F(27-546)
augaaggccauccuggugguccuccuguacaccuucgcuacagccaacgcgauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauacagcucugaucugcuuuucgucuuugggccuaaucugcaagaccccguuuccaacagcaugaccauccaggccauuucucaggcguucggaggcaacuaugaaacgcuccugcggacacuuggguacgccaccgagggauuugaugaccugcucgaguccgauagcaucacaggccagauuaucuauguggaccuguccggguacuauauuaucgugcgcgucuacuucccuauccugaccgaaauucaacaggcuuauauccaggagcuccugcccgugucuuuuaauaacgauaauagcgaauggauuuccaucguuccuaacuucauucuugugagaaauacccugaucagcaacauugagaucggauuuugucucaucacaaagcggucugucauuugcaaucaggacuacgccacgccgaugaccaacaauaugcgcgaaugucugacaggcuccaccgagaaaugccccagagagcuugugguuagcucucacgugccucgguucgcucugagcaacggcguccucuuugccaauuguaucuccgugacaugccaaugucagaccacggggcgcgccauuucucagagcggagaacaaacacugcugaugaucgacaacacaaccugccccaccgcuguccucggcaaugugauuaucucccuggggaaguaccuuggaagcguuaacuauaauucugagggcaucgcgauugggccucccguguucaccgauaaggucgacaucuccagccagauuucuuccaugaaccagagccugcagcaauccaaagauuacaucaaggaagcccagagacuccuggacacagugaacccgucucugauuagcaugcuuuccaugaucauccucuauguucugucuauugcuagccuguguaucggacucauuacguuuaucuccuucauuaucguggagaaaaagcggaauaccuacagccgccuggaagauagacggguccgcccuacaucuuccggcgaccuuuauuacaucggcaccuga

SEQ ID NO: 1200 - RNA, 1614 nt, Artificial Sequence
  derived and/or modified CDS sequence (opt5) from Nipah henipavirus__CAF25496__H1N1-HA(1-17)_F(27-546)
augaaggccauccuggugguccuccuguacaccuucgcuacagccaacgcgauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgauugaggacuuugaugaccuccuggagagcgauucuaucaccggacagauuaucuacgucgaccuguccagcuauuacauuaucgugcgcguuuauuucccuauccucacagaaauucaacaggccuacauccaggagcugcuucccguguccuuuaacaaugacaacucugaauggauuagcaucgucccuaauuucauucuggugagaaacacccucaucuccaauauugagaucggcuuuugucugaucaccaagcggagcguuauuugcaaccaggauuaugcuacaccgaugacgaauaacaugcgcgaaugucuuaccgggucuacagagaaaugccccagagagcugguggucuccagccacgugccucgguucgcccucucuaauggaguccuguuugcuaacuguaucagcgugaccugccaaugucagacaaccggccgcgccauuucccagucuggcgaacaaacgcugcucaugaucgacaauacaaccugccccaccgccguucuggggaacgugauuaucagccuuggaaaguaccugggcuccgucaauuacaacagcgaggggaucgcuauuggaccucccguguucacagauaagguugacaucucuucccagauuagcucuaugaaucagucccuccagcaaagcaaagauuauaucaaggaagcgcagagacugcuggacaccgugaacccgucccuuauuucuaugcucagcaugaucauccuguacguccuguccauugccucucucugcaucggccugauuacauuuaucagcuucauuaucguggagaaaaagcggaacacguauucccgccuugaagauagacgggugcgcccuaccagcucuggggaccuguacuauaucggaacauga

SEQ ID NO: 1201 - RNA, 1614 nt, Artificial Sequence
  derived and/or modified CDS sequence (opt5) from Nipah henipavirus__AAM13405__H1N1-HA(1-17)_F(27-546)
augaaggccauccuggugguccuccuguacaccuucgcuacagccaacgcgauccuccacuaugaaaaacugucuaagauugggcuugugaaaggagugacccggaaguacaaaaucaagagcaauccccugacaaaggauaucgucauuaaaaugaucccuaacguguccaauaugucucaguguacgggcagcguuauggagaacuauaagacccgccucaaugggauucugacaccgaucaaaggagcccuggaaauuuacaagaacaauacccaugaccucgugggcgaugucagacuggcuggggugaucauggccggaguugcgauuggcaucgcuacagccgcccaaaucaccgcuggcguggcccuuuaugaggcuaugaaaaacgccgacaauauuaacaagcugaaguccucuaucgaaagcacaaaugaggcggucgugaaacuccaggagaccgccgaaaagacgguguacguccugaccgcccuucaggauuauauuaacacaaaucugguucccaccaucgacaaaauuuccugcaagcagacagagcucagccuggaucuggcucucucuaaauaccuguccgaccuucuguucguguuugggccuaaccuccaagaucccgugagcaauucuaugaccauccaggcuaucucccaggccuucggaggcaacuacgaaacgcugcuucggacacugggguaugcgaccgaggacuuugaugaccuccuggagagcgauucuauuacaggacagaucauuuacgucgaccuguccagcuauuacaucauugugcgcguuuauuucccuauccucaccgaaauccaacaggccuacauucaggagcugcuucccguguccuuuaacaaugacaacucugaauggaucagcauugucccuaauuucauccuggugagaaacacccucauuuccaauaucgagauuggcuuuugucugaucacaaagcggagcguuaucugcaaccaggauuaugcuacgccgaccacaaauaacaugcgcgaaugucuuaccgggucuacagagaaaugccccagagagcugguggucuccagccacgugccucgguucgcccucucuaauggaguccuguuugcuaacuguauuagcgugaccugccaaugucagacgacaggccgcgccaucucccagucuggcgaacaaacccugcucaugauugacaauaccacaugccccaccgccguucuggggaacgugaucauuagccuuggaaaguaccugggcuccgucaauuacaacagcgaggggaucgcuaucggaccucccguguucacagauaagguugacauuucuucccagaucagcucuaugaaucagucccuccagcaaagcaaagauuauauuaaggaagcgcagagacugcuggacacggugaacccgucccuuaucucuaugcucagcaugauuauccuguacguccuguccaucgccucucucugcauuggccugaucaccuuuauuagcuucaucauuguggagaaaaagcggaacacauauucccgccuugaagauagacgggugcgcccuaccagcucuggggaccuguacuauaucggaacauga

SEQ ID NO: 1202 - RNA, 1614 nt, Artificial Sequence
  derived and/or modified CDS sequence (opt5) from Nipah henipavirus__CBM41033__H1N1-HA(1-17)_F(27-546)
augaaggccauccuggugguccuccuguacaccuucgcuacagccaacgcgauccuccacuaugaaaaacugagcaagauugggcuugugaaaggagugacccggaaguacaaaaucaaguccaauccccugacaaaggauaucgucauuaaaaugaucgccaacgugucuaauaugagccagugcacgggcuccguuauggagaacuauaagacccgccucaaugggauucugacaccuaucaaaggagcucuggaaauuuacaagaacaauacccaugaccucgugggcgaugucagacuggccggggugaucauggcgggaguugcuauuggcaucgccacagccgcucaaaucaccgccggcguggcucuuuaugaggccaugaaaaacgcggacaauauuaacaagcugaagucuagcaucgaauccacaaaugaggccgucgugaaacuccaggagaccgcugaaaagacgguguacguccugaccgcccuucaggauuauauuaacacaaaucugguuccgaccaucgacaaaauuagcuguaagcagacagagcucucucuggaucuggcucucuccaaauaccugagcgaccuucuguucguguuugggcccaaccuccaagauccugugucuaauuccaugaccauccaggccaucagccaggcguucggaggcaacuacgaaacgcugcuucggacacugggguaugccaccgaggacuuugaugaccuccuggagucugauuccauuacaggacagaucauuuacgucgaccugagcuccuauuacaucauugugcgcguuuauuuccccauccucaccgaaauccaacaggcuuacauucaggagcugcuuccugugucuuuuaacaaugacaacagcgaauggaucuccauuguccccaauuucauccuggugagaaacacccucauuagcaauaucgagauuggcuuuugccugaucacaaagcggucuguuaucuguaaccaggauuaugccacgccuaugaccaauaacaugcgcgaaugccuuacaggguccaccgagaaauguccgagagagcugguggucagcucucacgugccccgguucgcucucagcaauggaguccuguuugccaacugcauuuccgugacaugucaaugccagaccacgggccgcgccaucucucagagcggcgaacaaacacugcucaugauugacaauaccaccuguccuacagcuguucuggggaacgugaucauuucccuuggaaaguaccugggcagcgucaauuacaacucugaggggaucgcgaucggacccccuguguucaccgauaagguugacauuuccagccagaaaucuuccaugaaucagagccuccagcaauccaaggauuauaucaaagaagcccagagacugcuggacacagugaaccccucucuuauuagcaugcucuccaugaucauucuguacguccugucuaucgcuagccucugcaucggccugauuacguuuaucuccuucauuaucguggagaagaaacggaacaccuauagccgccuugaagauagacgggugcgcccgacaucuuccggggaccuguacuauauuggaaccuga

SEQ ID NO: 1203 - RNA, 1614 nt, Artificial Sequence
  derived and/or modified CDS sequence (opt5) from Nipah henipavirus__AEZ01396__H1N1-HA(1-17)_F(27-546)
augaaggccauccuggugguccuccuguacaccuucgcuacagccaacgcgauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauaccugagcgaucuucuguucgucuuugggccuaaucuccaagaccccguuucuaacuccaugaccauccaggccauuagccaggcguucggaggcaacuaugaaacgcugcuucggacacugggguacgccaccgaggauuuugacgaucuccuggagucugacuccaucacaggacagauuaucuauguggaucugagcggcuacuauauuaucgugcgcgucuacuucccuauccucaccgaaauucaacaggcuuauauccaggagcugcuucccguguccuuuaauaacgacaauucugaauggauuagcaucguuccuaacuucauucuggugagaaauacccucaucuccaacauugagaucggguuuugucugaucacaaagcggagcgucauuugcaaucaggacuacgccacgccgaugaccaacaauaugcgcgaaugucuuacaggaucuaccgagaaaugccccagagagcuggugguuuccagccacgugccucgguucgcucucucuaacggcguccuguuugccaauuguaucagcgugacaugccaaugucagaccacgggccgcgccauuucccagucuggggaacaaacacugcucaugaucgauaacacaaccugccccaccgcuguccugggaaaugugauuaucagccuuggcaaguaccugggguccguuaacuauaauagcgagggaaucgcgauuggcccucccguguucaccgacaaggucgauaucucuucccagauuagcucuaugaaccagucccuccagcaaagcaaagacuacaucaaggaagcccagagacugcuggauacagugaacccgucccuuauuucuaugcucagcaugaucauccuguauguucuguccauugcuucucucuguaucgggcugauuacguuuaucagcuucauuaucguggagaaaaagcggaauaccuacucccgccuugaagacagacggguccgcccuacaagcucuggagaucuguauuacaucggcaccuga

SEQ ID NO: 1204 - RNA, 1614 nt, Artificial Sequence
  derived and/or modified CDS sequence (opt5) from Hendra henipavirus__NP_047111__H1N1-HA(1-17)_F(27-546)
augaaggccauccuggugguccuccuguacaccuucgcuacagccaacgcgauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaaaaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucgccgggcaaauugucuauguggaucugucuuccuacuauaucauuguucggguguacuucccuauccuuaccgagauucagcaggcuuauguccaggaacugcuccccgugagcuuuaacaacgacaauuccgaguggaucucuaucguuccuaacuucgugcugauucgcaauacccuuaucagcaacauugaagucaaguacugccugaucacaaagaaguccgugauuuguaaucaagacuaugccacgccgaugaccgccagcgucagagagugccucacaggaucuaccgauaaguguccccgggagcuggugguuuccagccacgugccucgcuuugcucugucuggcggcguccucuucgcgaacugcaucagcgugacaugucagugccagaccacggggagagccauuucccaaucuggagaacagacacugcuuaugaucgacaauaccaccuguacaaccguugugcugggcaacaucauuaucagccucgggaaauaccugggauccauuaauuacaacagcgagucuaucgcugucgggcccccuguguauacagauaagguggacauuuccagccagaucucuuccaugaaucagagccugcaacaguccaaagauuacaucaaggaagcccagaaaauucuugacacgguuaaccccucucucaucagcaugcuguccaugauuauccuguauguccucucuauugccgcucugugcaucggccuuaucaccuuuauuagcuucgugaucguggagaagaagcggggaaauuacucccgccuggaugacagacagguccggccggugagcaacggcgaucucuauuacauuggcacauga

SEQ ID NO: 1205 - RNA, 1614 nt, Artificial Sequence
  derived and/or modified CDS sequence (opt5) from Hendra henipavirus__AEB21233__H1N1-HA(1-17)_F(27-546)
augaaggccauccuggugguccuccuguacaccuucgcuacagccaacgcgauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucaccgggcaaauugucuauguggaucugucuuccuacuauaucauuguucggguguacuucccuauccuuaccgagauucagcaggccuauguccaggaacugcuccccgugagcuuuaacaacgacaauuccgaguggaucucuaucguuccuaacuucgugcugauucgcaauacacuuaucagcaacauugaagucaaguacugccugaucacgaaaaaguccgugauuuguaaucaagacuaugcuaccccgaugacagccagcgucagagagugccucaccggaucuacagauaaguguccccgggagcuggugguuuccagccacgugccucgcuuugcccugucuggcggcguccucuucgcuaacugcaucagcgugaccugucagugccagacgacagggagagcgauuucccaaucuggagaacagacccugcuuaugaucgacaauaccacauguaccacaguugugcugggcaacaucauuaucagccucgggaaauaccugggauccauuaauuacaacagcgagucuaucgccgucgggcccccuguguauacggauaagguggacauuuccagccagaucucuuccaugaaucagagccugcaacaguccaaagauuacaucaaggaagcucagaaaauucuugacaccguuaaccccucucucaucagcaugcuguccaugauuauccuguauguccucucuauugccgcccugugcaucggccuuaucacauuuauuagcuucgugaucguggagaagaagcggggaaauuacucccgccuggaugacagacagguccggccggugagcaacggcgaucucuauuacauuggcaccuga

SEQ ID NO: 1206 - RNA, 1617 nt, Artificial Sequence
  derived and/or modified CDS sequence (opt5) from Hendra henipavirus__AEQ38114__H1N1-HA(1-17)_F(26-546)
augaaggccauccuggugguccuccuguacaccuucgcuacagccaacgcgggaauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugucugaucuccuguucguguuuggcccuaaucuucaggaccccguguccaacagcaugacgauucaggcgaucucucaggccuucgggggaaauuacgagacacugcucagaacccugggcuacgcuacagaggauuuugacgaucugcucgaauccgacagcaucaccgggcaaauugucuauguggaucugucuuccuacuauaucauuguucggguguacuucccuauccuuaccgagauucagcaggccuauguccaggaacugcuccccgugagcuuuaacaacgacaauuccgaguggaucucuaucguuccuaacuucgugcugauucgcaauacacuuaucagcaacauugaagucaaguacugccugaucacgaaaaaguccgugauuuguaaucaagacuaugcuaccccgaugacagccagcgucagagagugccucaccggaucuacagauaaguguccccgggagcuggugguuuccagccacgugccucgcuuugcccugucuggcggcguccucuucgcuaacugcaucagcgugaccugucagugccagacgacagggagagcgauuucccaaucuggagaacagacccugcuuaugaucgacaauaccacauguaccacaguugugcugggcaacaucauuaucagccucgggaaauaccugggauccauuaauuacaacagcgagucuaucgccgucgggcccccuguguauacggauaagguggacauuuccagccagaucucuuccaugaaucagagccugcaacaguccaaagauuacaucaaggaagcucagaaaauucuugacaccguuaaccccucucucaucagcaugcuguccaugauuauccuguauguccucucuauugccgcccugugcaucggccuuaucacauuuauuagcuucaucauuguggagaagaagcggggaaauuacucccgccuggaugacagacaggugcggccggucagcaacggcgaucucuauuacaucggcaccuga

SEQ ID NO: 1207 - RNA, 1614 nt, Artificial Sequence
  derived and/or modified CDS sequence (opt5) from Hendra henipavirus__AAB39505__H1N1-HA(1-17)_F(27-546)
augaaggccauccuggugguccuccuguacaccuucgcuacagccaacgcgauccuucacuacgagaaacuguccaagauuggccucgugaaagggaucacacggaaguauaaaauuaagucuaacccccugacgaaggacaucgugaucaaaaugauuccuaaugucagcaacguguccaagugcaccggaacaguuauggaaaauuacaaaucucgccugaccggcauccucagcccgauuaagggggcuaucgagcuguauaacaauaacacacaugaucuugugggagacgucaaacuggccggcgugguuauggcgggcauugcuaucgggauugccaccgccgcucaaaucacagccggaguggcucucuacgaagccaugaagaaugcggauaacaucaauaagcugaaauccucuauugagagcaccaacgaggccgucgugaaacuucaggaaacggcugagaagaccguguauguccugacagcccuccaggacuacaucaauaccaaccugguucccacaauugaucagaucuccuguaagcaaaccgaacuggcucucgaccuggcccuuagcaaauaucugcucauuugcucuuguuucggcccuaaucugcaggaucccguguccaacagcaugacgauccaggcgaucucucaggccuuugggggaaauuacgagacacuucugagaacccucggcuacgcuacagaggacuucgaugaccugcuggaauccgauagcauuaccgggcaaaucguguaugucgaccucucuuccuacuauauuaucgugcggguuuacuuuccuauucugaccgagauccagcaggccuaugugcaggaacuucugcccgucagcuucaacaacgauaauuccgaguggaucucuauugugccuaacuuuguucucauccgcaauacacugauuagcaacaucgaagugaaguacugccuuauuacgaaaaaguccgucaucuguaaucaagacuaugcuaccccgaugacagccagcgugagagagugccugaccggaucuacagacaaguguccccgggagcucgucguguccagccacguuccucgcuucgcccugucuggcggcgugcuguuugcuaacugcauuagcgucaccugucagugccagacgacagggagagcgaucucccaaucucgggaacagacccuccugaugaucgauaauaccacaugcaccacagugguucuuggaaacauuaucauuagccugcccaaauaccucggcuccaucaagcugcaagugcugcgcgcccuucuccuggggcaucagagcauucagacgaaagucgacaucucuucccagaucagcucuaugaaucagucccugcagcaaagcaaggauuacauuaaagaggcucagaagauccucgacaccgugaacccuucccugauuucuaugcuuagcaugaucauucuguaugugcucuccaucgccgcccuguguaucggacugauuacauucaucucuuuuguuauugucgaaaagaaaagaggcaauuacagccggcuugaugaccgccaggugagacccguguccaacggggaucucuauuacaucggaaccuga

SEQ ID NO: 1208 - RNA, 1650 nt, Artificial Sequence
  derived and/or modified CDS sequence (opt5) from Nipah henipavirus__AAK50554__H1N1-HA(1-17)_G(70-602)
augaaggccauccuggugguccuccuguacaccuucgcuacagccaacgcgcagaauuacacacggagcaccgauaaccaagcggucauuaaggacgcucuccaggggauccagcagcaaauuaaaggacuggccgauaagaucggcacagaaaucgggccgaaagugucccuuauugacaccucuagcacaaucaccauucccgccaauaucggacugcucggcuccaagauuagccagucuacggcuuccaucaacgagaauguuaacgaaaagugcaaauucacccugccuccccugaagauccacgaguguaauauuagcugcccuaacccccucccuuuucgcgaguauagaccgcagacagaaggcgugucuaaucuggucgggcuucccaacaauaucugucugcagaaaaccuccaaccaaauucucaagccuaaacugaucagcuacacacuucccgugguuggacagucugggaccugcauuacggauccucugcucgccauggacgagggcuauuucgcuuacucccaucuggaacggaucggaagcuguucccgcggcgugucuaagcagagaaucauuggggucggagaggugcuggaucggggcgacgaggugcccagccucuuuaugacaaacgucuggaccccgccuaaucccaacacaguuuaucacugcuccgccguguacaauaacgaguucuacuaugugcugugugcggucagcaccgugggcgauccuauccuuaauucuaccuacugguccgggagccugaugaugacacgccucgccguuaaacccaagucuaacggaggcggguauaaucagcaucaacuggcucuuagaagcauugaaaagggacgguacgacaaagugaugcccuauggcccuuccgggaucaagcagggagauacgcuguacuuuccggccgucggcuuccucgugcgcaccgaauuuaaauauaacgacucuaauugccccauuacaaagugucaguacagcaaaccugagaacugcagacuguccaugggcauccggcccaauagccacuacauucugcgcucugggcuccugaaguauaaccuuuccgacggagaaaauccuaagguuguguucaucgagaucagcgaucaaagacugucuauuggcucccccagcaaaaucuacgacucccucgggcagccggucuuuuaucaggcuucuuucagcugggauaccaugauuaaguuuggagacgugcugacagucaacccucuugugguuaauuggcggaacaacaccgugaucucccgccccggccagucucaauguccuagauucaauacgugccccgagauuugcugggaaggggucuacaacgaugccuuccugaucgaccggaucaauuggauuagcgcgggcguguuucucgauuccaaccagacagccgagaauccuguuuucaccguguuuaaagacaacgaaauccuguauagagcucagcuggccagcgaggauaccaaugcucagaagacaauuaccaacuguuuccuccugaaaaauaagaucuggugcauuucucuugucgaaaucuacgacacaggagauaacgugauccgccccaagcuguuugccgugaaaauuccggagcaauguacguga

SEQ ID NO: 1209 - RNA, 1650 nt, Artificial Sequence
  derived and/or modified CDS sequence (opt5) from Nipah henipavirus__AEZ01389__H1N1-HA(1-17)_G(70-602)
augaaggccauccuggugguccuccuguacaccuucgcuacagccaacgcgcagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccauucuuaauucuaccuacuggagcggcucccugaugaugaccagacucgccguuaagccuaaaaacaauggggaaucuuauaaccagcaucaauuugcucugcggaauaucgaaaagggaaaauacgacaaggugaugcccuauggccccagcgggauuaaacagggagauacacuuuacuucccugccgucggcuuucuggugcgcacggaguucaaguauaacgacuccaauugcccgaucgcugaaugucaguacagcaagcccgagaacugcagacucucuauggggauucggccuaauucccacuacauccugcgcagcggacugcucaaauauaaccugucugacgaggaaaauuccaagauuguuuuuaucgagaucagcgaucaaagacuuuccauuggcucucccagcaaaaucuacgacucccugggccagccuguguucuaucaggccucuuuuagcugggauaccaugauuaaguucggggacguccagacagugaacccccucgucgugaacuggcgggauaauaccguuaucucccgcccgggacaaagccaguguccuagauucaacaaaugccccgaagugugcugggagggcgucuacaaugacgcguuucugauugaucggaucaacuggaucucugccgggguguuccuugacuccaaucagacagcugaaaacccuguuuuuaccguguucaaggauaaugagguccuguaucgcgcccagcucgcuagcgaggacacgaacgcccaaaagacaauuaccaauuguuuucugcugaaaaacaagaucuggugcauuucucucguggaaaucuacgauaccggagacaaugugauuagacccaaacuguucgccguuaagaucccugagcaguguacauga

SEQ ID NO: 1210 - RNA, 1650 nt, Artificial Sequence
  derived and/or modified CDS sequence (opt5) from Nipah henipavirus__ACT32615__H1N1-HA(1-17)_G(70-602)
augaaggccauccuggugguccuccuguacaccuucgcuacagccaacgcgcagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccguucuuaauucuaccuacuggagcggcucccugaugaugaccagacucgccgugaagccuaaaaacaauggggaaucuuauaaccagcaucaauuugcucugcggaauauugaaaagggaaaauacgacaaggucaugcccuauggccccagcgggaucaaacagggagauacacuuuacuucccugccgugggcuuucugguucgcacggaguucaaguauaacgacuccaauugcccgauugcugaaugucaguacagcaagcccgagaacugcagacucucuauggggauccggccuaauucccacuacauucugcgcagcggacugcucaaauauaaccugucugacgaggaaaauuccaagaucguguuuauugagaucagcgaucaaagacuuuccaucggcucucccagcaaaauuuacgacucccugggccagccugucuucuaucaggccucuuuuagcugggauaccaugaucaaguucggggacgugcagacagucaacccccucgugguuaacuggcgggauaauaccgugauuucccgcccgggacaaagccaguguccuagauucaacaaaugccccgaagucugcugggagggcguguacaaugacgcguuucugaucgaucggauuaacuggaucucugccgggguuuuccuugacuccaaucagacagcugaaaacccuguguuuaccgucuucaaggauaaugaggugcuguaucgcgcccagcucgcuagcgaggacacgaacgcccaaaagacaaucaccaauuguuuucugcugaaaaacaagauuuggugcaucucucucguggaaauuuacgauaccggagacaauguuaucagacccaaacuguucgccgucaagauuccugagcaguguacauga

SEQ ID NO: 1211 - RNA, 1650 nt, Artificial Sequence
  derived and/or modified CDS sequence (opt5) from Nipah henipavirus__CAF25497__H1N1-HA(1-17)_G(70-602)
augaaggccauccuggugguccuccuguacaccuucgcuacagccaacgcgcagaacuacacacggagcaccgauaaucaagcggucaucaaggacgcucuccaggggauucagcagcaaaucaaaggacuggccgauaagauuggcacagaaaucgggccgaaagugucccuuaucgacaccucuagcacaauuaccauccccgccaacauuggacugcucggcuccaagaucagccagucuacggcuuccauuaaugagaacguuaaugaaaagugcaaauucacccugccuccccugaagauccacgaguguaacaucagcugcccuaauccccucccuuuucgcgaguauagaccgcagacagaaggcgugucuaaccuggucgggcuucccaauaacauuugucugcagaaaaccuccaaccaaauccucaagccuaaacugauuagcuacacacuucccgugguuggacagucugggaccugcaucacggauccucugcucgccauggacgagggcuauuucgcuuacucccaucuggaacggauuggaagcuguucccgcggcgugucuaagcagagaaucaucggggucggagaggugcuggaucggggcgacgaggugcccagccucuuuaugacaaaugucugggccccgccuaaccccaauaccguuuaucacugcuccgcgguguacaacaaugaguucuacuaugugcugugugccgucagcacagugggcgauccuauucuuaacucuaccuacugguccgggagccugaugaugacccgccucgcuguuaaacccaagucuaauggaggcggguauaaccagcaucaacuggcccuuagaagcaucgaaaagggacgguacgacaaagugaugcccuauggcccuuccgggauuaagcagggagauacacuguacuuuccggcugucggcuuccucgugcgcacggaauuuaaauauaaugacucuaacugccccaucaccaagugucaguacagcaaaccugagaauugcagacuguccaugggcauucggcccaacagccacuacauccugcgcucugggcuccugaaguauaaucuuuccgacggagaaaacccuaagguuguguucauugagaucagcgaucaaagacugucuaucggcucccccagcaaaauuuacgacucccucgggcagccggucuuuuaucaggccucuuucagcugggauacaaugaucaaguuuggagacgugcugaccgucaauccucuugugguuaacuggcggaacaauacagugauuucccgccccggccagucucaauguccuagauucaauaccugccccgagaucugcugggaaggggucuacaacgaugcguuccugauugaccggaucaacuggaucagcgccggcguguuucucgauuccaaucagacggcugagaacccuguuuucacaguguuuaaagacaaugaaauucuguauagagcccagcuggcuagcgaggauaccaacgcccagaagaccaucacaaauuguuuccuccugaaaaacaagauuuggugcaucucucuugucgaaauuuacgacaccggagauaaugugauccgccccaagcuguuugccgugaaaaucccggagcaauguacauga

SEQ ID NO: 1212 - RNA, 1650 nt, Artificial Sequence
  derived and/or modified CDS sequence (opt5) from Nipah henipavirus__CBM41034__H1N1-HA(1-17)_G(70-602)
augaaggccauccuggugguccuccuguacaccuucgcuacagccaacgcgcagaacuacacacggagcaccgauaaucaagcggucaucaaggacgcucuccaggggauucagcagcaaaucaaaggacuggccgauaagauuggcacagaaaucgggccgaaagugucccuuaucgacaccucuagcacaauuaccauccccgccaacauuggacugcucggcuccaagaucagccagucuacggcuuccauuaaugagaacguuaaugaaaagugcaaauucacccugccuccccugaagauccacgaguguaacaucagcugcccuaauccccucccuuuucgcgaguauagaccgcagacagaaggcgugucuaaccuggucgggcuucccgauaauauuugucugcagaaaaccuccaaccaaauccucaagccuaaacugauuagcuacacacuucccgugguuggacagucugggaccugcaucacggacccucugcucgccauggaugagggcuauuucgcuuacucccaucuggaacggauuggaagcuguucccgcggcgugucuaagcagagaaucaucggggucggagaggugcuggaccggggcgaugaggugcccagccucuuuaugacaaacgucuggaccccgccuaaucccaacacaguuuaucacugcuccgccguguacaauaacgaguucuacuaugugcugugugcggucagcaccgugggcgacccuauucuuaauucuaccuacugguccgggagccugaugaugacacgccucgccguuaaacccaagucuaacggaggcggguauaaucagcaucaacuggcucuuagaagcaucgaaaagggacgguacgauaaagugaugcccuauggcccuuccgggauuaagcagggagacacgcuguacuuuccggccgucggcuuccucgugcgcaccgaauuuaaauauaacgacucuaauugccccaucacaaagugucaguacagcaaaccugagaacugcagacuguccaugggcauucggcccaauagccacuacauccugcgcucugggcuccugaaguauaaccuuuccgauggagaaaauccuaagauuguuuucaucgagaucagcgaccaaagacugucuauuggcucccccagcaaaguguacgauucccucgggcagccggucuuuuaucaggcuucuuucagcugggacaccaugaucaaguuuggagaugugcagacagucaacccucuggugguuaauuggcgggacaacaccgugauuucccgccccggccaaucucaguguccuagauucaacacgugccccgagaucugcugggaaggggucuacaaugaugccuuccuuauugaccggaucaacuggaucagcgcgggcguguuucuggauuccaaucagacagccgagaacccuguuuucaccguguuuaaagacaaugaaauucucuauagagcucagcuggccagcgaggauaccaacgcucaaaagacaaucaccaauuguuuccugcucaaaaacaagauuuggugcaucucucuggucgaaauuuacgacacaggagacaaugugauccgccccaaacuuuuugccgugaagaucccggagcaguguacguga

SEQ ID NO: 1213 - RNA, 1650 nt, Artificial Sequence
  derived and/or modified CDS sequence (opt5) from Nipah henipavirus__AAX51853__H1N1-HA(1-17)_G(70-602)
augaaggccauccuggugguccuccuguacaccuucgcuacagccaacgcgcagaacuacacacgguccaccgauaaucaagcggugaucaaggacgcucuccaggggauucagcagcaaaucaaaggacuggccgauaagaucggcacagaaauugggccgaaagucucucuuaucgacaccagcuccacaauuaccauccccgccaacauuggacugcucggcagcaagaucucucaguccacggcuagcaucaaugagaacgugaaugaaaagugcaaauucacccugccuccccugaagauucacgaguguaacaucucuugcccuaauccccucccuuuucgcgaguauagaccgcagacagaaggcguuuccaaccugguggggcuucccaauaacauuugucugcagaaaaccagcaaucaaauccucaagccuaaacugauuucuuacacacuucccgucgugggacaguccgggaccugcaucacggauccucugcucgccauggacgagggcuauuucgcuuacagccaucuggaacggaucggauccuguucucgcggcguuagcaagcagaaaauuaucggggugggagagguccuggauagaggcgacgaggugcccucccucuuuaugacaaacguguggaccccgccuaaccccaauacagucuaucacugcagcgccguuuacaacaaugaguucuacuaugugcugugugcggugucuaccgucggcgauccuauucuuaacuccaccuacuggagcgggucucugaugaugacacggcucgccgugaagcccaagagcaaugacggaggcuauaaccagcaucaacuggcccuucgcuccaucgaaaaagggagauacgauaagguuaugcccuauggaccuucuggcauuaaacagggggacacgcuguacuuuccggcugugggauuccucguccggaccgaauuuaaguauaaugacagcaacugccccaucacaaaaugucaguacuccaagccugagaauugccgccugagcaugggcauuagacccaacucucacuacgugcugcgguccggccuccugaaguauaaucuuagcgauggggaaaacccuaaaaucguuuucaucgagauuucugaccaacgccuguccaucggaagccccuccaagauuuacgauucucucggccagccgguguuuuaucaggcuagcuucuccugggacaccaugaucaaauuuggggauguccagacagugaauccucuggucgugucuuggagagacaacaccguuauuagccggcccggacaaucccaguguccucgcuucaauacgugccccgagaucugcugggaaggcguguacaacgaugccuuccuuaucgacagaauuaacuggaucagcgcgggggucuuucuggauucuaaucagacagccgagaacccuguguucaccguuuuuaaggacaaugaaauucucuaucgggcucagcuggccuccgaggauaccaacgcucagaaaacaaucaccaauuguuuccugcucaagaacaagauuuggugcaucagccugguggaaaucuacgacacaggcgacaaugucauuagacccaaacuuuuugccgugaagaucccggagcaauguacguga

SEQ ID NO: 1214 - RNA, 1650 nt, Artificial Sequence
  derived and/or modified CDS sequence (opt5) from Nipah henipavirus__AEZ01397__H1N1-HA(1-17)_G(70-602)
augaaggccauccuggugguccuccuguacaccuucgcuacagccaacgcgcagaauuacacacgguccaccgauaaccaagcgaugaucaaggacgcucuccagucuauucagcagcaaaucaaagggcuggccgauaagauuggaacagaaaucggcccgaaagucagccuuaucgacaccuccagcacaauuaccauccccgccaauauugggcugcucggaucuaagaucucccagagcacggcuucuauuaacgagaaugugaacgaaaagugcaaauucacccugccuccccugaagauccacgaguguaauaucuccugcccuaacccccucccuuuucgcgaguauaaaccgcagacagaaggcguuagcaaucuggugggccuucccaacaauauuugucugcagaagaccucuaaccaaauccucaaaccuaagcugauuuccuacacacuucccgucguggggcagagcggaaccugcaucacggauccucugcucgccauggacgagggcuauuucgcuuacucccaucuggagaaaauugggucuuguagcagaggaguuuccaagcagcggaucaucggcgugggggaaguccuggaucgcggagacgaggugcccagccucuuuaugacaaacguguggaccccgucuaauccuaacacagucuaucacugcuccgccguuuacaauaacgaguucuacuaugugcugugugcggugagcgucgugggcgaucccauucuuaauucuaccuacuggagcggcucccugaugaugaccagacucgccguuaagccuaaaaacaauggggaaucuuauaaccagcaucaauuugcucugcggaauaucgaaaagggaaaauacgacaaggugaugcccuauggccccagcgggauuaaacagggagauacacuuuacuucccugccgucggcuuucuggugcgcacggaguucaccuauaacgacuccaauugcccgaucgcugaaugucaguacagcaagcccgagaacugcagacucucuauggggauucggccuaauucccacuacauccugcgcagcggacugcucaaguauaaccugucugacgaggaaaauuccaaaauuguuuuuaucgagaucagcgaucaaagacuuuccauuggcucucccagcaagaucuacgacucccugggccagccuguguucuaucaggccucuuuuagcugggauacaaugauuaaauucggggacguccagaccgugaacccccucgucgugaacuggcgggauaauacaguuaucucccgcccgggacaaagccaguguccuagauucaacaagugccccgaagugugcugggagggcgucuacaaugacgcguuucugauugaucggaucaacuggaucucugccgggguguuccuugacuccaaucagaccgcugaaaacccuguuuuuacgguguucaaagauaaugagguccuguaucgcgcccagcucgcuagcgaggacacaaacgcccaaaagaccauuaccaauuguuuucugcugaagaacaaaaucuggugcauuucucucguggaaaucuacgauacaggagacaaugugauuagacccaagcuguucgccguuaaaaucccugagcaguguaccuga

SEQ ID NO: 1215 - RNA, 1656 nt, Artificial Sequence
  derived and/or modified CDS sequence (opt5) from Hendra henipavirus__NP_047112__H1N1-HA(1-17)_G(70-604)
augaaggccauccuggugguccuccuguacaccuucgcuacagccaacgcgcaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucgcgaucaccaagguggaacgggggaaauacgauaaggugaugccuuauggacccagcggcauuaaacaaggggacacacuguacuuucccgccgucggauuccugccucgcaccgaguuucaguauaaugauuccaacugcccgaucauucacuguaaguacagcaaagcugagaauugcagacucucuaugggcgugaacuccaagagccacuauauccugcggucugggcuucugaaguacaaucucucccugggaggcgacauuauccuucaguucaucgaaauugccgauaaccgccugacgaucggcagccccuccaaaauuuacaauucucucgggcaaccuguguuuuaucaggcuagcuacuccugggacacaaugaucaagcugggagauguugacaccgucgauccccugagagugcaguggcggaacaauucuguuauuagccgcccuggccagucccaaugucccagauucaacgugugcccggaggucugcugggaagggaccuauaaugacgccuuucucaucgaccggcugaacugggugagcgcgggagucuaccuuaacucuaaucagacagccgagaacccuguguucgcuguuuucaaagauaaugaaauccuguaucaggugccccucgccgaggacgauaccaacgcucagaagacaauuacggacuguuuucugcuggagaaugucaucuggugcauuucccuuguggaaaucuacgauaccggcgacagcguuauuagaccuaaacucuucgccgugaagauccccgcccaauguucugaguccuga

SEQ ID NO: 1216 - RNA, 1656 nt, Artificial Sequence
  derived and/or modified CDS sequence (opt5) from Hendra henipavirus__AEB21225__H1N1-HA(1-17)_G(70-604)
augaaggccauccuggugguccuccuguacaccuucgcuacagccaacgcgcaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucgcgaucaccaagguggaacgggggaaauacgauaaggugaugccuuauggacccagcggcauuaaacaaggggacacacuguacuuucccgccgucggauuccugccucgcaccgaguuucaguauaaugauuccaacugcccgaucauucacuguaaguacagcaaagcugagaauugcagacucucuaugggcgugaacuccaagagccacuauauccugcggucugggcuucugaaguacaaucucucccugggaggcgacauuacgcuucaguucaucgaaaucgccgauaaccgccugacaauuggcagccccuccaaaaucuacaauucucucgggcaaccuguguuuuaucaggcuagcuacuccugggacaccaugauuaagcugggagauguugacaccgucgauccccugagagugcaguggcggaacaauucuguuaucagccgcccuggccagucccaaugucccagauucaacgugugcccggaggucugcugggaagggacauauaaugacgccuuucucauugaccggcugaacugggugagcgcgggagucuaccuuaacucuaaucagaccgccgagaacccuguguucgcuguuuucaaagauaaugaaauccuguaucaggugccccucgccgaggacgauacaaacgcucagaagacgaucaccgacuguuuucugcuggagaaugucauuuggugcaucucccuuguggaaauuuacgauacaggcgacagcguuaucagaccuaaacucuucgccgugaagauucccgcccaauguucugaguccuga

SEQ ID NO: 1217 - RNA, 1656 nt, Artificial Sequence
  derived and/or modified CDS sequence (opt5) from Hendra henipavirus__AEB21216__H1N1-HA(1-17)_G(70-604)
augaaggccauccuggugguccuccuguacaccuucgcuacagccaacgcgcaaaauuacacgagaaccacagauaaccaggcgcuuaucaaagagucucugcagagcgugcagcaacagauuaaggcucucaccgacaaaaucggcacagaaaucgggccuaaggucucccugauugauaccucuagcacaaucaccauuccggccaauaucggacugcucggcuccaaaauuagccagucuacguccagcaucaacgagaaugugaacgacaagugcaaguuuacccugcccccucuuaaaauccacgaauguaauauuucuugccccaacccucugcccuuccgggaguaucgcccuaucucccagggcguuagcgaucucguggggcugccgaaucaaauuugucuucagaagacaaccucuacaauccugaaacccagacucauuuccuacacccugccuaucaacacgcgggaaggagucugcaucacagacccccugcucgccguggauaacggcuuuuucgcuuauagccaucuggagaagauuggguccuguacccgcggaaucgccaaacagagaauuaucggcguuggggaggugcuugaccggggagauaaggucccuucuauguuuaugacaaauguguggacacccccgaacccuagcaccauucaccauugcuccagcaccuaccacgaagacuucuauuacacgcugugugcugugucucaugucggcgaccccauccucaauuccaccagcuggacagagucucugagccuuauucgccuggccguuagaccuaaauccgauucuggcgacuacaaccagaaguauaucgcgaucaauaagguggaacgggggaaauacgauaaggugaugcccuauggacccagcggcauuaaacaaggggacacccucuacuuuccugccgucggauuccugccgcgcacagaguuucaguauaacgauuccaauugccccaucauucacuguaaguacagcaaagcugagaacugcagacugucuaugggcguuaauuccaagagccacuauauccuccggucugggcugcuuaaguacaaccugucccucggaggcgacauuauccugcaguucaucgaaauugccgauaaucgccuuaccaucggcagcccuuccaaaauuuacaacucucuggggcaacccguguuuuaucaggcuagcuacuccugggacacgaugaucaagcucggagauguggacacagucgauccucugagagugcaguggcggaauaacucuguuauuagccgccccggccagucccaauguccgagauucaaugugugcccugaggucugcugggaagggaccuauaacgacgccuuucugaucgaccggcucaacugggugagcgcgggagucuaccuuaauucuaaccagaccgccgagaaucccguguucgcuguuuucaaagauaacgaaauccuguaucaggugccucuggccgaggacgauacaaaugcucagaagaccauuacagacuguuuucuccuggagaacgucaucuggugcauuucccugguggaaaucuacgauacgggcgacagcguuauuagacccaaacuuuucgccgugaagaucccugcccaauguucugaguccuga

SEQ ID NO: 1218 - RNA, 1656 nt, Artificial Sequence
  derived and/or modified CDS sequence (opt5) from Hendra henipavirus__AEB21206__H1N1-HA(1-17)_G(70-604)
augaaggccauccuggugguccuccuguacaccuucgcuacagccaacgcgcaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcaacuacaaucagaaguauaucgcgaucaccaagguggaacgggggaaauacgacaaggugaugccuuauggacccagcggcauuaaacaaggggauacacuguacuuucccgccgucggauuccugccucgcaccgaguuucaguauaacgacuccaauugcccgaucauucacuguaaguacagcaaagcugagaacugcagacucucuaugggcguuaauuccaagagccacuauauccugcggucugggcuucugaaguacaaccucucccugggaggcgauauuauccuucaguucaucgaaauugccgacaaucgccugacgaucggcagccccuccaaaauuuacaacucucucgggcaaccuguguuuuaucaggcuagcuacuccugggauacaaugaucaagcugggagacauugauaccguggacccccugagaguccaguggcggaauaacucugugaucagccgcccuggccagucccaaugucccagauucaauguuugcccggaggugugcugggaagggaccuauaacgaugccuuucucaucgaccggcugaacugggucagcgcgggaguguaccuuaauucuaaccagacagccgagaauccugucuucgcuguguucaaagacaacgaaauucuguaucagguuccccucgccgaggaugacaccaaugcucagaagacaaucacggauuguuuucugcuggagaacgugauuuggugcaucucccuugucgaaauuuacgacaccggcgauagcgugaucagaccuaaacucuucgccguuaagauccccgcccaauguucugaguccuga

SEQ ID NO: 1219 - RNA, 1656 nt, Artificial Sequence
  derived and/or modified CDS sequence (opt5) from Hendra henipavirus__AEQ38052__H1N1-HA(1-17)_G(70-604)
augaaggccauccuggugguccuccuguacaccuucgcuacagccaacgcgcaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucaccaucacaaagguggaacgggggaaauacgauaaggugaugccuuauggacccagcggcauuaaacaaggggacacccuguacuuucccgcggucggauuccugccucgcacggaguuucaguauaaugauuccaacugcccgaucauucacuguaaguacagcaaagccgagaauugcagacucucuaugggcgugaacuccaagagccacuauauccugcggucugggcuucugaaguacaaucucucccugggaggcgacauuauccuucaguucaucgaaauugcugauaaccgccugacaaucggcagccccuccaaaauuuacaauucucucgggcaaccuguguuuuaucaggccagcuacuccugggacaccaugaucaagcugggagauguugacaccgucgauccccugagagugcaguggcggaacaauucuguuauuagccgcccuggccagucccaaugucccagauucaacgugugcccggaggucugcugggaagggacauauaaugacgcuuuucucaucgaccggcugaacugggugagcgccggagucuaccuuaacucuaaucagaccgcggagaacccuguguucgccguuuucaaagauaaugaaauccuguaucaggugccccucgcugaggacgauacaaacgcccagaagacgauuaccgacuguuuucugcuggagaaugucaucuggugcauuucccuuguggaaaucuacgauacaggcgacagcguuauuagaccuaaacucuucgcugugaagauccccgcccaauguucugaguccuga

SEQ ID NO: 1220 - RNA, 1656 nt, Artificial Sequence
  derived and/or modified CDS sequence (opt5) from Hendra henipavirus__AEQ38115__H1N1-HA(1-17)_G(70-604)
augaaggccauccuggugguccuccuguacaccuucgcuacagccaacgcgcaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauaacggcgacuacaaucagaaguauaucgcgaucaccaagguggaacgggggaaauacgauaaggugaugccuuauggacccucuggcauuaaacaaggggacacacuguacuuucccgccgucggauuccugccucgcaccgaguuucaguauaacgauagcaauugcccgaucauucacuguaaguacuccaaagcugagaacugcagacucagcaugggcguuaauucuaagucccacuauauccugcggagcgggcuucugaaguacaaccucucucugggaggcgacauuauccuucaguucaucgaaauugccgauaaucgccugacgaucggcucccccagcaaaauuuacaacucccucgggcaaccuguguuuuaucaggcuucuuacagcugggacacaaugaucaagcugggagauguggacaccgucgauccccugagagugcaguggcggaauaacuccguuauuucucgcccuggccagagccaaugucccagauucaaugugugcccggaggucugcugggaagggaccuauaacgacgccuuucucaucgaccggcugaacuggguguccgcgggagucuaccuuaauagcaaccagacagccgagaauccuguguucgcuguuuucaaagauaacgaaauccuguaucaggugccccucgccgaggacgauaccaaugcucagaagacaauuacggacuguuuucugcuggagaacgucaucuggugcauuucucuuguggaaaucuacgauaccggcgacuccguuauuagaccuaaacucuucgccgugaagauccccgcccaauguagcgagucuuga

SEQ ID NO: 1221 - RNA, 1656 nt, Artificial Sequence
  derived and/or modified CDS sequence (opt5) from Hendra henipavirus__AEQ38108__H1N1-HA(1-17)_G(70-604)
augaaggccauccuggugguccuccuguacaccuucgcuacagccaacgcgcaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagucuacguccagcaucaacgagaaugugaacgacaagugcaaguuuacccuuccgccccugaaaauccacgaauguaauauuucuugcccuaacccccucccuuuccgggaguaucgccccaucucccagggcguuagcgaucugguggggcuuccuaaucaaauuugucugcagaagacaaccucuacaauccucaaaccgagacugauuuccuacacccugcccaucaacacgcgggaaggagucugcaucacagacccucuccuggccguggauaacggcuuuuucgcuuauagccaucuugagaagauuggguccuguacccgcggaaucgccaaacagagaauuaucggcguuggggaggugcuggaccggggagauaagguccccucuauguuuaugacaaauguguggaccccucccaacccgagcaccauucaccauugcuccagcacauaccacgaagacuucuauuacacgcucugugcugugucucaugucggcgacccuauccuuaauuccaccagcuggacagagucucugagccugauucgccucgccguuagacccaaauccgauucuggcgacuacaaccagaaguauaucaccaucacaaagguggaacgggggaaauacgauaaggugaugccuuauggacccagcggcauuaaacaagggaauacccuguacuuucccgcggucggauuccugccucgcacggaguuucaguauaacgacuccaauugcccgaucauucacuguaaguacagcaaagccgagaacugcagacucucuaugggcguuaauuccaagagccacuauauccugcggucugggcuucugaaguacaaccucucccugggaggcgauauuauccuucaguucaucgaaauugcugacaaucgccugacaaucggcagccccuccaaaauuuacaacucucucgggcaaccuguguuuuaucaggccagcuacuccugggauaccaugaucaagcugggagacguggauaccgucgacccccugagagugcaguggcggaauaacucuguuauuagccgcccuggccagucccaaugucccagauucaaugugugcccggaggucugcugggaagggacauauaacgaugcuuuucucaucgaccggcugaacugggugagcgccggagucuaccuuaauucuaaccagaccgcggagaauccuguguucgccguuuucaaagacaacgaaauccuguaucaggugccccucgcugaggaugacacaaaugcccagaagacgauuaccgauuguuuucugcuggagaacgucaucuggugcauuucccuuguggaaaucuacgacacaggcgauagcguuauuagaccuaaacucuucgcugugaagauccccgcccaauguucugaguccuga

SEQ ID NO: 1222 - RNA, 1656 nt, Artificial Sequence
  derived and/or modified CDS sequence (opt5) from Hendra henipavirus__AAV80426__H1N1-HA(1-17)_G(70-604)
augaaggccauccuggugguccuccuguacaccuucgcuacagccaacgcgcaaaauuacacgagaaccacagauaaccaggcgcugaucaaagagucucuccagagcgugcagcaacagauuaaggcucugaccgacaaaaucggcacagaaaucgggcccaaggucucccugauugauaccucuagcacaaucaccauuccugccaauaucggacuccugggcuccaaaauuagccagugcacgucuuccaucaacgagaaugugaacgacaaguguaaguuuacccuuccgccccugaaaauccacgaaugcaauauuagcuguccuaacccccucccuuuccgggaguaucgccccaucucucagggcguuuccgaucugguggggcuuccuaaucaaauuugccugcagaagacaaccagcacaauccucaaaccgagacugauuucuuacacccugcccaucaacacgcgggaaggagucuguaucacagacccucuccuggccguggauaacggcuuuuucgcuuauucccaucuugagaagauugggagcugcacccgcggaaucgccaaacagagaauuaucggcguuggggaggugcuggaccggggagauaagguccccuccauguuuaugacaaauguguggaccccucccaacccgucuaccauucaccauuguagcuccacauaccacgaagacuucuauuacacgcucugcgcugugagccaugucggcgacccuauccuuaauucuaccuccuggacagagagccugucucugauucgccucgccguuagacccaaaagcgauuccggcgacuacaaccagaaguauaucgcgaucaccaagguggaacgggggaaauacgauaaggugaugccuuauggacccucuggcauuaaacaaggggacacacuguacuuucccgccgucggauuccugccucgcaccgaguuucaguauaaugauagcaacuguccgaucauucacugcaaguacuccaaagcugagaauuguagacucagcaugggcgugaacucuaagucccacuauauccugcggagcgggcuucugaaguacaaucucucucugggaggcgacauuauccuucaguucaucgaaauugccgauaaccgccugacgaucggcucccccagcaaaauuuacaauucccucgggcaaccuguguuuuaucaggcuucuuacagcugggacacaaugaucaagcugggagauguugacaccgucgauccccugagagugcaguggcggaacaauuccguuauuucucgcccuggccagagccaaugccccagauucaacgugugcccggaggucuguugggaaggguccuauaaugacgccuuucucaucgaccggcugaacugggugagcgcgggagucuaccuuaacucuaaucagaccgccgagaacccuguguucgcuguuuucaaagauaaugaaauccuguaucaggugccccucgccgaggacgauacaaacgcucagaagaccauuacagacugcuuucugcuggagaaugucaucugguguauuucccuuguggaaaucuacgauacgggcgacagcguuauuagaccuaaacucuucgccgugaagauccccgcccaaugcucugaguccuga

SEQ ID NO: 1223 - RNA, 1614 nt, Artificial Sequence
  derived and/or modified CDS sequence (opt6) from Nipah henipavirus__AAK50553__H1N1-HA(1-17)_F(27-546)
augaaagcaaucuuagucguacucuuauacacauucgcgaccgcaaacgcaauauuacauuacgaaaaacucucaaaaauaggauuagucaaaggaguaaccagaaaauauaaaaucaaauccaacccuuuaacaaaagacauagucauaaaaaugauccccaacguuagcaauaugucacaaugcacaggaucaguaauggaaaauuacaaaacaagacuaaacggcauucuaacucccaucaaaggagcacuugaaauauauaaaaacaauacucacgaccuuguaggagacguacgacuagccggaguaauuauggccggaguagcaauagguauagcgacagccgcgcaaauaacagcaggcgucgcacucuacgaagccaugaaaaacgcagauaauauaaacaaauuaaaaucauccauugaaagcaccaacgaagcaguaguaaaacuacaagaaaccgcagaaaaaacugucuauguacuaacagcauuacaagacuauaucaauacaaaccuagucccuacaaucgauaaaauaaguugcaaacaaaccgaacuaucauuagacuuagcauuaucaaaauaccuauccgacuuacuauucguauuuggccccaauuuacaagaccccguaucuaauaguaugacaauccaagccauaucucaagcauuuggaggaaacuaugaaacacuauuaagaacacuaggauacgcaacagaagacuucgacgaccuauuagaaucagauuccauaacaggacaaauaauauacguagaccuaucaucguauuacauaauaguaagaguauacuucccaauauuaacagaaauacaacaagcauacauacaagaauuacuacccguaucauucaauaaugacaacucagaauggauaagcauaguaccaaauuucauccucgucagaaacacauugauaaguaauauagaaaucgguuucugccuaaucacaaagagaucaguaauaugcaaccaagacuacgcaacaccaaugacaaacaauaugcgcgaaugcuuaacaggcucaacagaaaaaugcccaagagaacuagucguuucaucacacguaccacgauuugcccuauccaacggaguacuauuugccaacugcaucucaguaacaugccaaugucaaacuacaggacgagcuauuucccaauccggagaacaaacacuccucaugauagacaauacaacuuguccaacagcuguacuuggaaacguaauaauuucccucggcaaauaccuaggaucaguaaauuauaauucagaaggaauagccauaggacccccaguguucaccgacaaaguagacaucucaucccaaauuucaucaaugaaccaaucucuccaacaaucaaaagauuacaucaaagaagcacaaagacuauuagauaccguaaaccccucauuaauaucaaugcuaucaaugaucaucuuauacgucuuaucaauagcaucacuaugcauaggacucaucaccuuuauauccuuuaucauaguagaaaaaaaaagaaacaccuacuccagauuagaagauagacgaguaagaccuacaucaucaggagacuuauacuacaucggcacauaa

SEQ ID NO: 1224 - RNA, 1614 nt, Artificial Sequence
  derived and/or modified CDS sequence (opt6) from Nipah henipavirus__AEZ01388__H1N1-HA(1-17)_F(27-546)
augaaagcaaucuuagucguacucuuauacacauucgcgaccgcaaacgcaauacuacauuacgaaaaacuaucaaaaauaggucucgucaaagggauuacaagaaaauacaaaauaaaaucaaacccccuaacaaaagacauagucauaaaaaugauaccaaacguaucaaauaugucacaauguacaggaagcguaauggaaaacuacaaaacacgacuuaacggaaucuuaacaccuauaaaaggagcuuuagaaauauacaaaaauaacacacacgaucuaguaggagauguucgacucgcaggagucauaauggcaggcguagccauagguauagcaaccgccgcacaaauuaccgcaggaguagccuuauacgaagcaaugaaaaacgccgauaacauaaacaaacuaaaaucauccaucgaaucaaccaacgaagcagucguaaaacuacaagaaaccgccgaaaaaacagucuauguccuaacagcauuacaagacuacauaaauaccaaucuuguuccaacaauagauaaaauuucaugcaaacaaacagaacuaucucucgaccuagcauuaucaaaauacuuauccgaccuacuauucguauuuggacccaaccuacaagaucccgucucuaacucuaugacaauccaagcaaucucacaagccuucggaggaaauuacgaaacauuacuaagaacacucggauaugcaacagaagacuucgacgaucuacuagaaagcgauuccauaaccggacaaauaauauacgucgaucuauccggauauuacaucauaguuagaguauauuucccaauauuaacagaaauacaacaagcauacauacaagaacuacuccccgucucuuuuaacaacgauaacuccgaauggauaucaauugucccaaacuucauacuaguccgcaauacacuaauuuccaauauagaaauagguuucugucucaucacaaaaagaucagucauaugcaaccaagacuaugcaacacccaugacaaauaacaugagagaaugccuaaccggcucaaccgaaaaaugcccacgagaacuaguuguaucuucacaugucccccgcuucgcacucucuaacggaguauuauucgcaaacugcauaucaguaacuugccaaugucaaacaacaggcagagccauaucacaaucuggagaacaaacacuauuaaugaucgacaauacaacauguccaacagcaguccuaggaaacguaauaauaucacuaggcaaauaccuaggaucaguaaacuacaacuccgaaggaaucgcaauaggaccccccgucuuuacagacaaagucgacauauccucacaaauauccucaaugaaucaaucucuacaacaauccaaagacuacauuaaagaagcacaaagacuauuagauacaguuaacccaucccucauauccauguuaucaaugauaauacuauauguccuaucaaucgcaucccucuguaucggauuaaucacauucauaucauuuauuauaguagaaaaaaaacgaaacaccuacuccagacuugaagaucgacgaguaagaccaaccucaucaggcgauuuauauuacauuggaacauaa

SEQ ID NO: 1225 - RNA, 1614 nt, Artificial Sequence
  derived and/or modified CDS sequence (opt6) from Nipah henipavirus__AAY43915__H1N1-HA(1-17)_F(27-546)
augaaagcaaucuuagucguacucuuauacacauucgcgaccgcaaacgcaauacuccacuaugaaaaauuaucaaaaauaggauuagucaaaggaauaacaagaaaauauaaaaucaaaucaaauccccuaacaaaagauaucguaauuaaaaugauaccaaauguaucaaauaugagucaaugcaccggaagcguaauggaaaauuauaaaacacgcuuaaacggaauacuaaccccaaucaaaggagcuuuagaaauuuauaaaaacaacacacaugauuuaguaggcgauguaagacuagcaggcguaauuauggcuggcguugcaauaggaauagcuacagcugcccaaauaaccgcuggagucgcacucuaugaagcaaugaaaaacgcugacaacauaaauaaacuaaaaucaucaauagaaagcaccaaugaagccgucguaaaacuacaagaaacagcagaaaaaacaguauacguauuaaccgcuuuacaagacuauauaaauacuaacuuaguccccacaauugacaaaauuuccugcaaacagacagaacuaucacucgauuuagcauuaucaaaauacucuuccgacuuacuauucguauucgguccuaaucuacaagacccagucuccaacuccaugacuauccaagcaauaucccaagcauuuggaggaaauuaugaaacacucuuaagaacccucggauacgcaacagaaggcuucgaugaccuacucgaauccgacaguaucacaggacaaauaauauauguagacuuaucuggauacuauauaauaguaagaguauacuuuccaauucuaacagaaauacaacaagccuacauccaagaacuauuaccuguuucauuuaacaaugacaacuccgaauggauaucaauaguacccaauuucauccuuguuaggaacacccuaauauccaacauugaaaucggauuuuguuuaauaaccaaacgaucagucaucugcaaccaagauuaugcaacaccaaugaccaacaacaugagagaaugccuaacaggaucaacagaaaaauguccacgagaacuaguagucucaucccauguaccaagauucgccuuaucuaacgguguacuauucgcaaacugcaucaguguuaccugccaaugucaaaccacaggcagagccauaucucaaucuggagaacaaacacuacucaugauagacaauacaacuuguccaaccgcaguauuaggcaacguuauaauaucauuaggaaaauaccuaggaagugucaacuauaacucagaaggaauugcuauaggaccacccguauucacagauaaaguagacauauccucacaaauaucauccaugaaccaaucauuacaacaaucuaaagauuacauaaaagaagcacaaagacuauuagacacaguaaauccaucauuaauaucuaugcuaucaaugauaauacuauauguccucucaauugcuucacuuugcauaggccuaauaaccuuuaucucauucauaauaguagaaaaaaaacgaaacacauacuccagacuagaagacagacgaguuagacccacauccucaggugaccuauauuacauaggaacauaa

SEQ ID NO: 1226 - RNA, 1614 nt, Artificial Sequence
  derived and/or modified CDS sequence (opt6) from Nipah henipavirus__CAF25496__H1N1-HA(1-17)_F(27-546)
augaaagcaaucuuagucguacucuuauacacauucgcgaccgcaaacgcaaucuuacauuaugaaaaacuaucaaaaauuggauuaguaaaagguguaacacgaaaauacaaaaucaaaucaaacccucuaacaaaagauauagucauaaaaaugauccccaacguaucaaacaugucacaauguaccggaucaguaauggaaaacuauaaaacgagauuaaacggaauucuaaccccaauaaaaggugcucuugaaauauauaaaaacaacacacacgaccuagucggagacguaagacuagcuggcguaauaauggccgguguagcaauaggaauagcaacagccgcacaaauaacagcuggcgucgcccuauacgaagcaaugaaaaaugcagacaacauuaacaaacuaaaaucaucaauagaauccacaaacgaagccguaguaaaauuacaagaaaccgcagaaaaaacaguauauguauuaaccgcacuucaagacuacauaaacaccaaucucguaccaacaauagacaaaauaucuuguaaacaaacagaacuaucacuagaucuagcauuaagcaaauacuuaucagacuuacucuucguauuuggaccaaaccuacaagaccccguaucaaacucaaugacaauacaagccauaucacaagcauuuggaggaaacuacgaaacacuauuaagaacacucggcuaugccauagaagacuucgacgaucuauuagaaucagauucaauaacaggccaaauaauauauguagaccucaguucauauuacaucauaguccgaguuuacuucccaauccuaacagaaauacaacaagcauacauacaagaacuacuaccaguauccuucaacaacgacaacucugaauggauaucaauagucccuaauuuuauacuaguaagaaacacauuaauaagcaacauagaaauaggauucugccuaauaacaaaaagauccguuauauguaaccaagacuacgcaacccccaugacaaacaacaugagagaaugucuaacaggcucaaccgaaaaauguccuagagaauuagucguaucaucacauguaccaagauucgcacuaucaaauggaguacucuucgcaaauuguaucucaguuaccugccaaugccaaaccaccggaagagcaauaucacaaucuggagaacaaacauuacuaaugaucgauaacacuacuugucccacagcaguucuuggaaacgucaucauaucacuaggaaaauaccuaggcucaguaaacuacaauagcgaagguauagccauuggaccaccaguuuuuacugacaaaguagacaucucaagucaaauaucaucaaugaaccaaagcuuacaacaaucuaaagauuauauaaaagaagcacaaaggcuacuagacaccgucaacccaucauuaauaagcaugcuaucaaugauaauuuuauauguauuauccaucgcuucucuaugcauaggccuaauaaccuucauaagcuucauuauuguugaaaaaaaaagaaauacauacucacgacuagaagacagaagaguccgaccaacauccucaggagauuuauauuauauaggaaccuaa

SEQ ID NO: 1227 - RNA, 1614 nt, Artificial Sequence
  derived and/or modified CDS sequence (opt6) from Nipah henipavirus__AAM13405__H1N1-HA(1-17)_F(27-546)
augaaagcaaucuuagucguacucuuauacacauucgcgaccgcaaacgcaauacuccauuacgaaaaacuaucaaaaauaggcuuaguuaaaggaguaacaagaaaauacaaaauaaaaucaaauccacuaacuaaagauauaguaaucaaaaugauacccaacguaucaaauaugucacaauguacuggaucaguuauggaaaauuacaaaacaagauuaaacggaauucucacacccauaaaaggagcacuagaaauuuacaaaaauaacacucacgaccuagucggcgacguaagauuagcagguguaaucauggcagguguagccaucggcauagcaacagcagcccaaauaaccgccggcguugcuuuauaugaagcaaugaaaaacgcagauaauauaaacaaauuaaaaucaucaauagaaucaacaaacgaagcuguaguaaaacuucaagaaacagcagaaaaaacaguauacguacuaacagcuuuacaagacuacaucaacacaaaccuaguaccaacgauagacaaaauaucaugcaaacaaacagaacuaucuuuagaucuagcauuaucaaaauaucuaagcgaccuucucuucguguucggucccaaccuacaagacccagucucaaacucuaugacaauacaagcaauaucacaagcauucggaggcaacuaugaaacacuacucagaacacucggcuaugccacagaagacuucgacgauuuacuagaaucagacuccauaaccggacaaauuaucuacguagaccucucgucuuacuacauaauaguaagagucuauuuccccauauuaacagaaauccaacaagcauacauacaagaacuucuaccaguaucauucaauaacgacaacucagaauggauaucaauagucccaaauuucauacuaguacguaauaccuuaaucucaaauauagaaauaggauucuguuuaaucacaaaaagaucaguaauaugcaaccaagacuacgccacaccaacgacaaacaacaugcgcgaaugucucacuggaucuacagaaaaaugccccagagaacuaguaguaucuucccacguaccacgauucgcacuguccaauggaguauuauucgcaaacugcauaagcguaacuugccaaugccaaacuaccggccgcgcaauaucacaaucaggcgaacaaacucucuuaaugauagauaauaccacaugccccaccgccguacuaggcaauguaaucaucucauuagguaaauaccuaggaucagugaacuacaacucagaagguauagcaauugguccaccaguauuuacugacaaaguagacaucagcucacaaauauccucaaugaaucaaucauuacaacaaucaaaagacuauaucaaagaagcacaaagacucuuagacacaguaaacccaagcuuaauuagcaugcuauccaugaucauacucuauguacuuucaauagcaucccuuugcaucggacuaauaacuuuuaucucauucaucaucguagaaaaaaaacgaaacacuuacucaagacuagaagauagaagaguaagacccacaucaaguggagacuuauauuauauaggaacauaa

SEQ ID NO: 1228 - RNA, 1614 nt, Artificial Sequence
  derived and/or modified CDS sequence (opt6) from Nipah henipavirus__CBM41033__H1N1-HA(1-17)_F(27-546)
augaaagcaaucuuagucguacucuuauacacauucgcgaccgcaaacgcaauacuccauuacgaaaaacuuucaaaaauaggcuuaguaaaaggaguaacaagaaaauauaaaauaaaaucaaacccccuaacuaaagauauaguaauaaaaaugaucgcaaacguuucuaacaugucccaauguacaggaucaguaauggagaacuauaaaacaagauuaaauggaauauuaacaccaaucaaaggcgcacucgaaauauacaaaaacaacacacacgacuugguaggugauguacgacuagcaggagucaucauggccggcguagcaauaggaauagcuacagcagcacaaauaacagcaggaguagcauuauacgaagcaaugaaaaaugccgauaacauaaacaaauuaaaaucaucuauagaaucaacaaaugaagccguaguaaaacuacaagaaacagccgaaaaaacaguuuacguucuuacagccuuacaagauuauaucaauacaaauuuaguaccuacuaucgauaaaauauccugcaaacaaacagaacucucacucgaccuagcccucucuaaauaccuuucugauuuauuauucguauucggaccaaacuuacaagaucccguuucaaauuccaugacuauacaagcaauaagccaagcauuuggaggaaacuacgaaacacuucuaagaacauuagguuacgcaacugaagacuuugacgaccuacuagaaucagacucaaucacaggacaaaucaucuacguagacuuaucuucauacuacauaaucguccgaguauacuucccaauauuaacagaaauucaacaagccuauauacaagaacuacucccaguauccuuuaauaaugacaacucagaauggauaucaauagucccuaacuucauacuaguaagaaacaccuuaauuucaaacaucgaaauaggcuucugccuaauaaccaaacgaucaguaauaugcaaccaagacuacgcaacuccaaugacaaauaauaugcgagaauguuuaacaggaaguacagaaaaaugccccagagaauuagucguaucaucucaugucccaagauucgcacuaucaaauggaguacuauucgcaaacugcauaucaguaacaugucaaugucaaacuacuggccgugcaauaucucaaucaggagaacaaaccuuacucaugauagacaacacaaccugcccaacagcuguacuuggcaacguaauaaucucacuaggaaaauaccuaggaaguguaaacuauaacucugaggggauagcaauaggcccaccaguauucacagauaaaguagacauuagcucccaaaaaucaucuaugaaucaaucacuccaacaaucaaaagacuacauaaaagaagcacaacgcuuauuagacacaguaaauccaucacuaauaucaaugcuaucaaugauaauauuauacgucuuauccauagccagcuuauguauaggcuuaauaaccuucauauccuucauaaucguagaaaaaaaacgcaauaccuacucacgacucgaagacagacgaguaagaccaaccuccuccggagaccuauacuauaucggcacauaa

SEQ ID NO: 1229 - RNA, 1614 nt, Artificial Sequence
  derived and/or modified CDS sequence (opt6) from Nipah henipavirus__AEZ01396__H1N1-HA(1-17)_F(27-546)
augaaagcaaucuuagucguacucuuauacacauucgcgaccgcaaacgcaaucuuacacuacgaaaaacucuccaaaauaggccuaguaaaaggcauaacacgaaaauauaaaauaaaaucuaacccacuaacaaaagacaucguaauaaaaaugaucccaaacguauccaacaugucacaaugcacaggcucaguaauggaaaauuacaaaaccagacuaaauggcauuuuaacaccaauaaaaggagcacuagaaauuuacaaaaacaacacacacgaccuagucggagauguacgacuagccggagucauaauggcaggaguagcaauaggaauagccaccgcagcucaaauaacagcaggagucgcccuauaugaagccaugaaaaaugcugauaauauaaacaaauuaaaaucuucaaucgaaucaacaaacgaagcaguagucaaacuacaagaaacagcagaaaaaacagucuauguacuaacagcccuacaagacuacauaaacacaaauuuagucccuaccauagauaaaauaagcuguaaacaaacagaacucucacuagaccuagcccucucaaaauaccucucagaccuauuauuuguauucggacccaaccuccaagacccagucucuaacucuaugacaauacaagcgauaucccaagcauucggcgguaauuacgaaacauuacugcguacacuuggcuacgcaacagaagacuuugacgacuuauuagaaucagauucaauaaccggacaaauaauauacguagacuuauccggcuacuacauaauagucagaguauauuucccaauauuaaccgaaauccaacaagccuacauacaagaacuacuaccaguuucauucaacaaugauaacucugaauggaucucuaucguuccaaacuuuauuuuagugagaaacacccuaauaucaaacauugaaauaggcuucuguuuaauaacuaaaagaucaguuauaugcaaccaagacuacgcaacacccaugacaaauaacaugagagaaugccuaaccggcucaaccgaaaaaugcccacgagaauuagucguaucaucacacguaccacgcuucgcacucucaaauggaguccuuuucgcaaacugcauaucagucacuugucaaugccaaaccacaggcagagccauaucccaaucaggcgaacaaacccuacucaugauagacaauacaacauguccaacagcuguccucggcaauguuauaauaucccucggcaaauauuuagguucuguaaacuacaacucagaaggaauagcuaucggaccucccguauuuacagacaaaguagacaucucaucucaaauaucaucaaugaaccaaucccuacaacaaaguaaagacuacauaaaagaggcacaaagacuacuagacaccguaaacccguccuuaaucucuauguuaagcaugaucauacuauacguauuaucaauugcaucauuaugcauaggauuaauaacauucauuucauucauaauaguagaaaaaaaacgaaacaccuauucacgauuagaagaucgaagaguacgaccaacuagcuccggcgaccuauauuacaucggaacauaa

SEQ ID NO: 1230 - RNA, 1614 nt, Artificial Sequence
  derived and/or modified CDS sequence (opt6) from Hendra henipavirus__NP_047111__H1N1-HA(1-17)_F(27-546)
augaaagcaaucuuagucguacucuuauacacauucgcgaccgcaaacgcaauccuacacuacgaaaaacuaucaaaaaucggccuagucaaaggaauaacacguaaauacaaaauuaaaucuaacccacuaaccaaagacauaguaauaaaaaugauuccaaacguuagcaacgucucaaaaugcacaggaacagugauggaaaacuauaaaucaagacuaacaggaauacuaucccccauaaaaggugcaaucgaauuauacaacaacaauacccaugaucuaguaggagauguaaaauuagcuggaguugucauggccggcauagcaauaggaauugcaacagcagcccaaauaacagccggaguagcucuauaugaagcaaugaaaaacgccgauaauauaaacaaacuaaaaucgucaauagaaucaacuaaugaagcaguugucaaacuacaagaaacagcagagaaaacaguauacguccucacagcuuuacaagauuauauaaacacaaacuugguacccacaauagaucaaauaucuuguaaacaaaccgaacuagcacuagaccuagcacuguccaaauaccucucagaucuucuauucguauucggcccuaaccuacaagaccccguuucaaacucuaugacaauucaagcaauaucacaagccuucggaggaaacuacgaaacacuacucaggacacucgguuaugcaacagaagacuuugaugaucuucuugaaucagauucaauagcaggucaaauuguauacguagauuuauccucauacuacauaauaguaagagucuacuucccaauauuaacugaaauucaacaagcauacgugcaagaauuacuaccaguaucauucaacaacgauaacucagaauggauaaguauaguaccaaauuucguacucauaagaaauacucuaauaucaaacauagaagucaaauauugcuuaauuacaaagaaauccguaaucuguaaccaagacuacgcaacccccaugacagcaucugucagagaaugucucaccggaucaacagauaaaugcccacgagaauuaguaguauccucacacguaccuagauucgcauuaucaggcggaguccuauucgcaaauugcauaucuguaacaugccaaugccaaacaacaggacgugcaauaucccaaucaggagaacaaacacuauuaaugauagacaauacuaccuguacaaccguaguacucgguaacauaauaauaagucuaggaaaauauuugggaaguauaaacuacaauucagaaucaauagcaguaggaccacccguauacacagauaaaguagacauauccucacaaauuucaucgaugaaucaaucacuccaacaauccaaagacuacaucaaagaagcacagaaaauacuagacacaguaaaccccucacuuauauccauguuauccaugauaauucuauacguucucuccaucgcagcccuaugcauaggauuaauaacuuucauuucauucgucauaguagaaaagaaaagaggaaacuauaguagauuagaugacagacaagucagaccagucucaaacggcgauuuauacuacauaggcacauaa

SEQ ID NO: 1231 - RNA, 1614 nt, Artificial Sequence
  derived and/or modified CDS sequence (opt6) from Hendra henipavirus__AEB21233__H1N1-HA(1-17)_F(27-546)
augaaagcaaucuuagucguacucuuauacacauucgcgaccgcaaacgcaauacuacauuaugaaaaauuauccaaaauaggauuaguaaaaggaauuacaagaaaauacaaaauaaaaagcaauccucuaacaaaagacauaguaauaaaaaugauccccaauguaucuaacguaucaaaaugcacaggaacagucauggaaaauuacaaaucaagacuaacuggaauucuaucaccaauuaaaggcgcuauagaacuauacaauaauaacacacacgaucuuguaggcgacguaaaguuagcgggaguuguaauggcaggaauugccauagguaucgcaacagcagcccaaauaaccgcaggcguagcacuauacgaagccaugaaaaaugcagauaacauaaauaaauuaaaauccaguauugagucaacaaaugaagcaguaguaaaacuccaagaaacagcagaaaaaacagucuauguacucacagcccuucaagauuacaucaauacaaaccuaguaccaacaauagaccaaauaucauguaaacaaaccgaauuagcacuagaccuagcacuuucaaaauacuuaagugaccuuuuauuugucuucggccccaaccuacaagacccaguauccaacaguaugacaauacaagccauaagucaagcauucggagguaacuacgaaacccuccuaagaacccuaggauacgcaacagaagacuuugacgaccucuuagaaagcgauucaaucacaggacaaauaguuuacgucgacuuaucuaguuacuacauaauaguaagaguauacuuccccauucuaacugaaauucaacaagcauacguacaagaauuacuaccaguaucauucaacaacgacaacucagaauggaucucaauaguuccaaacuuuguacuaauucgaaauacacuaaucucaaauauagaaguaaaauacugccuuauaacaaaaaaauccguaauaugcaaccaagacuaugcaacaccaaugaccgcaucaguucgagaaugccucaccgguuccacagauaaauguccaagagaauuaguaguaucuucacacguaccaagauucgcuuuaucaggaggcguucuauuugcaaacugcaucagcgucacaugccaaugucaaacaacuggccgagcaauaucacaaucuggagaacaaacacucuuaaugauagacaacacuaccugcacaacaguaguacucggaaacaucauaauaucacuuggaaaauaccucggaucaauuaacuauaacagugaaucaaucgcuguuggucccccaguauauacagacaaagucgacaucagcucacaaauuucaucaaugaaccaaucacuucaacaaucaaaagauuauauaaaagaagcacaaaaaauacuagacacaguaaacccaucuuuaauuucaauguuaucaaugauaauauuauauguucuaucaauugccgcacuaugcauuggauuaauaaccuuuauaucuuuuguaauaguugaaaaaaaaagagguaauuauucucgccuugacgaucgccaaguacgcccaguauccaacggugaccucuauuauauuggaaccuaa

SEQ ID NO: 1232 - RNA, 1617 nt, Artificial Sequence
  derived and/or modified CDS sequence (opt6) from Hendra henipavirus__AEQ38114__H1N1-HA(1-17)_F(26-546)
augaaagcaaucuuagucguacucuuauacacauucgcgaccgcaaacgcaggaauucuacauuacgaaaaacuuagcaaaauaggacuaguaaaaggaauaacccgaaaauacaaaauaaaaucaaacccccuaacaaaagacauaguaauaaaaaugauaccaaaugucucaaacgucagcaaaugcacaggcaccgucauggaaaauuacaaaucacgacuaacaggaauauuaucaccaauaaaaggagcaaucgaacuauacaacaacaacacacacgaucuaguaggcgacguaaaacuagcaggaguagucauggccggaauagcaauaggaaucgcaacagcagcucaaauaacagcaggaguagcacuuuacgaagcuaugaaaaacgcagacaauauaaacaaacuaaaaucaucaaucgaaucaacaaacgaagcuguuguaaaauuacaagaaacagcugaaaaaacuguauacguccuaacagcccuccaagauuacaucaacacaaacuuagucccaacaauugaucaaauuucaugcaaacaaacagaacuagcucuagaucuagcccuaucaaaauaccuaucugaccuacuauuuguauucggucccaauuuacaagaucccguaucaaauucaaugacaauacaagcaauuagccaggcuuucggaggaaauuaugaaacacuacuacgcacacuaggauacgcgacagaagacuuugacgacuuauuagaaucugauucaauaaccggucaaaucguauauguagacuuaagcucuuacuacaucauaguuagaguauacuucccaauccucacagaaauacaacaagccuacguccaagaauuauuaccaguaucuuucaacaacgacaacucagaauggauaucaauaguuccaaacuucguuuuaauaagaaacacacuaaucucaaauauagaagucaaauacugcuuaauaaccaaaaaaucaguaauaugcaaccaagauuacgccacaccaaugaccgcuucaguacgagaaugccuaacaggaucaacagauaaaugccccagagaauuaguuguaucaucccacguuccaagauucgcacuaucaggaggaguacuuuucgcaaauugcauaucaguuacuugccaaugccaaacaaccggacgcgcaauuucucaauccggagaacaaacacuacuaaugaucgacaacacaaccugcacaacaguaguacuaggaaauauuauaaucucacuaggcaaauacuuagguucuauaaacuauaacagugaaucaauagcuguaggaccaccaguauacacagacaaagucgacauuucuucacaaauuucuucaaugaaucaauccuuacaacaaaguaaagacuauauaaaagaggcacaaaaaauacuugacaccguaaaucccucacuuauaucaauguuaucaaugaucauccucuacguacuaucaaucgcagccuuaugcauaggacuaauaacauuuauuucauuuauaauaguagaaaaaaaacgaggcaauuacaguagacuagacgacagacaaguacgaccuguaucaaauggugaccucuacuacauaggaacauaa

SEQ ID NO: 1233 - RNA, 1614 nt, Artificial Sequence
  derived and/or modified CDS sequence (opt6) from Hendra henipavirus__AAB39505__H1N1-HA(1-17)_F(27-546)
augaaagcaaucuuagucguacucuuauacacauucgcgaccgcaaacgcaauacuacacuacgaaaaauuaaguaaaaucggccuagucaaaggaauuacccgaaaauacaaaaucaaaucuaacccauuaaccaaagacauagucauaaaaaugauuccaaacgucucaaacguaucaaaaugcacuggaaccguaauggaaaacuauaaaucacgauuaaccggaauacuaucaccaauuaaaggagcaaucgaacuuuauaacaauaacacacacgaccuaguuggcgacguaaaacuugcagguguaguaauggcagguaucgccaucggaauagcaacugcagcucaaaucacagccggaguagcucucuacgaagccaugaaaaacgcagacaauauaaacaaauuaaaaucaagcauagaaucaaccaacgaagcaguuguuaaacuucaagaaaccgcugaaaaaaccguauauguucuaacagcacuacaagacuauauaaacacaaaccuaguacccacaaucgaucaaauuuccugcaaacaaaccgaacuagcccuugaucuugcacucagcaaauauuuacucauauguucauguuucggcccaaaucuacaagauccaguauccaauucaaugaccauacaagcaaucucacaagcauuuggagguaacuacgaaacacuccuaagaacauuaggcuacgcuacagaagauuucgaugaccuccucgaaucagacuccauaacaggacaaauaguauacgucgaccuaucauccuacuacauaauagucagagucuacuucccaauacuaacagaaauucaacaagcauauguacaagaacuacuaccugucucauucaacaacgacaacucugaauggauauccauaguccccaauuuuguccuaauaagaaacacacuaaucucaaacauagaaguuaaauauugcuuaauaaccaaaaaaucagucauauguaaccaagacuacgcaacaccaaugaccgcaucaguaagagaauguuuaacagguaguacagacaaauguccaagagaauuaguaguuagcucccacguaccaagauuugcacuaucaggcggcguacuauucgcuaacugcauaaguguaacaugucaaugccaaaccacugggcgagcaaucucacaaucucgagaacaaacacuucuaaugauagacaacacaacaugcaccacaguaguucuaggcaauaucauaaucucacuaccaaaauacuuaggauccauaaaacuucaaguacuaagagcuuuacuccucggccaccaaucaauccaaaccaaaguugacauaucuucacaaauaucaucaaugaaucaauccuuacaacaauccaaagacuauaucaaagaagcacaaaaaauuuuagauacuguuaaccccaguuuaauaucuaugcuaucaaugauuauauuauacguccucaguauagcagcauuaugcauaggacucauaacauuuauaucauucguaauaguugaaaaaaaacgaggaaauuacucaagacuugacgacagacaaguaagaccaguaucaaauggagauuuauacuacaucggcacuuaa

SEQ ID NO: 1234 - RNA, 1650 nt, Artificial Sequence
  derived and/or modified CDS sequence (opt6) from Nipah henipavirus__AAK50554__H1N1-HA(1-17)_G(70-602)
augaaagcaaucuuagucguacucuuauacacauucgcgaccgcaaacgcacaaaacuauacacguucuaccgauaaucaagcuguaauuaaagacgcauuacaaggaauucaacaacaaauaaaaggccuugccgacaaaauaggcacagaaauuggcccaaaaguaucuuuaauugacaccucaaguaccauaaccauacccgcuaauauaggacuauuaggcucaaaaauaucacaaucaacugcaucaauuaaugaaaacguaaacgaaaaaugcaaauuuacacuaccaccucuaaaaauccaugaaugcaacauaucuugcccaaaccccuuaccauuuagagaauaccgcccacaaacagaaggcguaucaaaccuaguaggccuacccaacaacauaugccuacaaaaaacaucuaaccaaauuuuaaaaccaaaauuaauaucuuacacauuaccagucgucggacaaagcggaaccugcauuacagacccacuacuagcaauggacgaaggauacuucgcauauucacaucuagaacguauaggaucauguucacguggugucucaaaacaacgaauaauaggaguaggcgaaguauuagaucgaggagacgaaguuccguccuuauucaugacaaaugucuggaccccaccaaaccccaacacaguguaccacugcucagcaguuuacaauaacgaauuuuauuacguacuaugcgcaguuucaacagucggagacccaauacuaaacaguacauauuggagcggaucauuaaugaugacaaggcucgccgucaaaccaaagagcaacggugguggauacaaucaacaccaacuagcacuaagaucaauagaaaaaggaagauacgacaaaguaaugccauacggcccaucaggaaucaaacaaggagauacauuauacuucccagcagucgguuuucuaguaagaacagaauuuaaauacaacgauucaaauuguccaaucacaaaaugccaauauucaaaaccagaaaacugcagacuaucgaugggaauacgcccaaacucccacuacauacuuagaucuggacuauuaaaauacaauuuaagcgauggagaaaacccaaaaguagucuucauugaaauaucagaccaaagacuaucaauaggaucaccaucaaaaauauaugacucacuaggacaaccaguauucuaccaagcuucauucucaugggauacaaugauuaaauuuggagauguauuaaccguaaaucccuuaguaguaaauuggagaaauaacacuguaauuucuagaccaggacaaagccaauguccgagauucaauacaugucccgaaauaugcugggaaggaguauacaaugacgcauuccuaaucgaucgaaucaacuggauaagugcaggcguauuccuagacucaaaucaaacagcagaaaacccagucuucacaguauucaaagacaaugaaauacucuauagagcacaacucgcuucagaagacacuaaugcacaaaaaacaauaacaaacuguuuuuuacucaagaacaaaaucuggugcauuucauuaguagaaaucuacgacacaggagacaaugucauuagaccaaaacuauucgcagucaaaauaccagaacaauguacauaa

SEQ ID NO: 1235 - RNA, 1650 nt, Artificial Sequence
  derived and/or modified CDS sequence (opt6) from Nipah henipavirus__AEZ01389__H1N1-HA(1-17)_G(70-602)
augaaagcaaucuuagucguacucuuauacacauucgcgaccgcaaacgcacaaaauuacacaagaucaacagacaaucaagccaugauaaaagacgcucuacaaagcauucaacaacaaauuaaaggcuuggcagacaaaauaggcacagaaauaggcccaaaaguaagcuuaauagacaccucuaguacaauuacaauacccgcaaauauaggguuauuaggaucaaaaauaagccaaaguacagccuccauaaacgaaaauguaaacgaaaaaugcaaauuuacucuaccaccacuaaaaauacaugaauguaauauauccugcccaaacccacucccauucagagaauacaaaccacaaacagaggguguaucaaauuuaguaggauuaccuaacaauauaugucuacaaaaaaccuccaaccaaauacuuaaaccuaaacuaauaucauacacacucccaguaguaggacaaagcggaacauguauaacagacccacuccuagcaauggacgaaggauacuuugcauauagucaccuagaaaaaauaggaucauguagccgaggcgucaguaaacaaagaauaauaggaguaggagaaguacuagaccgaggagaugaaguaccuucacuauuuaugacaaacguauggacuccuucaaacccaaauacaguauaucacugcucagccgucuacaacaaugaauucuacuacguguuaugcgcaguaucaguaguaggagauccaauauuaaacagcacauauuggucaggaucuuuaaugaugacaaggcuagcagucaaacccaagaacaacggagaaucauauaaccaacaccaauucgcacuaagaaacauagaaaaaggaaaauacgacaaaguaaugccauacggaccaucagguauuaaacaaggagacacccuuuacuucccagcagucggguuucuaguaagaacagaauuuaaauauaaugacucaaauugcccaauagcagaaugucaauauuccaagccagaaaauugccgacucuccaugggaauaagaccuaacucacauuacauucuaagauccggacuucuaaaauacaauuuaucagaugaagaaaauaguaaaauaguauucauagaaauuagcgaucaacggcuuucaauaggaucaccaucaaaaaucuacgauucauuaggccaacccguuuuuuaucaagcaucauucuccugggacacaaugauaaaauuuggagacguacaaacuguaaacccacuaguaguaaauuggagagacaacacaguaauaucacgacccggucaaucccaaugcccucgauuuaacaaaugcccagaaguaugcugggaaggaguauacaacgacgcauuucuuauugaccgcauaaacuggauaucagcaggugucuuccuagauucaaaccaaacugcugaaaaccccguauucacaguauucaaagacaacgaaguacucuacagagcucaacuagcaucugaagauacaaacgcacaaaaaaccauaacaaacugcuucuuauuaaaaaacaaaaucuggugcaucucacuaguagaaauauacgauacaggagacaaugucauaagaccaaaacuauucgcaguaaaaauccccgaacaaugcacauaa

SEQ ID NO: 1236 - RNA, 1650 nt, Artificial Sequence
  derived and/or modified CDS sequence (opt6) from Nipah henipavirus__ACT32615__H1N1-HA(1-17)_G(70-602)
augaaagcaaucuuagucguacucuuauacacauucgcgaccgcaaacgcacaaaacuauacaagaucaacagacaaucaagccaugauaaaagacgcuuuacaauccauccaacaacaaauaaaaggacuagcagauaaaaucggcacagaaauaggaccuaaaguaucucugauagauacuucaucaacaauaacuauaccagccaauauaggucuucuggguucaaaaauaucacaauccacugccuccaucaacgaaaacguaaaugaaaaaugcaaauuuaccuuacccccauuaaaaauacacgaaugcaacauaucauguccaaacccacuaccauucagagaauauaaaccucaaacagaaggagucucaaaccuaguuggcuuaccaaauaacaucugccuacaaaaaacauccaaccaaauauuaaaacccaaacuaauuucauacacacuuccaguaguaggacaauccggaacuuguauaacagaccccuuacucgcaauggacgaaggauacuuugcauauucccaccucgaaaaaaucggaucuugcucacgaggcguaucaaaacaacgaauuauaggaguaggagaaguauuagacagaggugaugaagucccaucauuauuuaugacaaacguauggacuccaagcaacccaaacacaguauaucacuguuccgccgucuacaauaacgaauucuacuaugucuuaugcgcuguaucaguaguaggugaccccguucuaaacucaacauacuggucuggcucacuaaugaugacaaggcuagccguaaaaccaaaaaauaacggagaaucauauaaucaacaccaauucgcacuaagaaacauagaaaaaggaaaauacgacaaagucaugccuuacggcccuuccggaauaaagcaaggagacacacuauauuuuccagccguagguuucuuaguacgaacugaauuuaaauauaacgacucaaacugccccaucgcugaaugucaauauucaaaaccagaaaauugcagacuaucaaugggaauaagaccaaauucacacuacauacuaagaagcggacuccuuaaauacaacuuaucagaugaagaaaacucuaaaauagucuucauagaaauauccgaccaaagacuauccauaggaucaccaucaaaaauauacgacucacuaggucaaccaguauucuaccaagccagcuucucaugggacaccaugauuaaauucggugauguacaaacagucaauccccuaguugucaacuggcgagacaauacaguaauauccagaccaggacaaucucaaugccccagauucaacaaaugucccgaaguauguugggaaggaguuuauaacgacgccuuucuaauagacagaaucaacuggauuucugcuggcgucuuccuagauucaaaccaaacagcagaaaacccaguauuuacuguauucaaagacaaugaaguacuauaccgugcacaauuagcaucugaagacacaaacgcacaaaaaacaaucacaaacugcuuucuacuaaaaaauaaaauauggugcauaucacuagucgaaauauacgacacaggcgacaacgucaucagaccuaaacuauucgcugucaaaauacccgaacaauguacauaa

SEQ ID NO: 1237 - RNA, 1650 nt, Artificial Sequence
  derived and/or modified CDS sequence (opt6) from Nipah henipavirus__CAF25497__H1N1-HA(1-17)_G(70-602)
augaaagcaaucuuagucguacucuuauacacauucgcgaccgcaaacgcacaaaauuauaccagaucuacagauaaucaagcaguuauaaaagaugcacuucaaggaauacaacaacaaauaaaaggucuagcagacaaaauaggaaccgaaauaggaccgaaagucucacuaauagacacuucaucaacuaucacaauaccagcaaauauaggccuacuaggaucaaaaauaagucaaagcacagcaucaauaaaugaaaauguaaacgaaaaaugcaaauuuacacucccaccccuaaaaauacaugaauguaacauaucaugcccaaacccacuacccuuucgagaauaccgcccucagacagaaggcgucuccaaccucguaggauuaccaaacaauauaugccuccaaaaaacuagcaaucaaauucuaaaaccaaaacuaauaucuuacacauuaccaguaguaggacaaucaggcacaugcauaacagacccacuuuuagcaauggacgaaggauacuucgcauauucacauuuagaacguauuggaucaugcucaagaggaguauccaaacaaagaauaauaggaguaggcgaaguccuagaccgaggcgaugaaguacccucccucuucaugacaaacgucugggcaccuccaaacccaaacacaguuuaucauugcuccgcaguauacaauaacgaauucuacuacguccuaugugcaguauccacagucggcgacccuauauuaaacuccacuuacuggagcggaucauuaaugaugaccagacuagccguaaaacccaaaaguaacggcgguggauauaaccaacaccaauuagcauuacguucaauagaaaaagggagauacgauaaaguaaugccauacgguccaucaggaauaaaacaaggagacacacuauacuuucccgcagucggcuucuuagucagaacagaauucaaauauaacgacucaaacugucccauaacaaaaugccaauauucaaaaccugaaaacugcagacuaucaaugggaauccgaccaaauucucacuacauccuuagaucaggcuuacugaaauauaaucucucagacggagaaaauccaaaaguaguauucaucgaaauaucagaucagagacuaucaauuggaucacccaguaaaauauacgacucucucggacaaccaguauuuuaccaagcuuccuucucaugggauacaaugauaaaauucggagacguacucacaguaaauccacucguaguaaacuggagaaauaauacaguuaucucacgucccggacaaucacaaugcccaagauucaacacauguccagaaauaugcugggaaggaguauacaaugaugcauuuuuaauagaccgaauaaauuggauaagugcaggaguauuuuuagacucaaaccaaacagcagaaaaccccguuuuuacaguauucaaagauaacgaaauauuauaccgugcccaacuagcaucugaagacacaaaugcacaaaagacuaucacuaauugcuuucuauuaaaaaacaaaauaugguguauaucuuuagucgaaauauacgauacaggagauaacguaauaagaccaaaacuguucgcaguaaaaauuccugaacaaugcacauaa

SEQ ID NO: 1238 - RNA, 1650 nt, Artificial Sequence
  derived and/or modified CDS sequence (opt6) from Nipah henipavirus__CBM41034__H1N1-HA(1-17)_G(70-602)
augaaagcaaucuuagucguacucuuauacacauucgcgaccgcaaacgcacaaaauuauacucgauccacagauaaccaagcugucauaaaagacgcauugcaagguauacaacaacaaauaaaaggucuagcugacaaaauuggaacagaaauaggaccaaaaguaucacugauagacacaucaucaaccauaaccauaccagcaaauauaggccuacuaggauccaaaauaucacaaagcaccgcauccauaaacgaaaacguaaacgaaaaaugcaaauuuacauuaccaccgcuaaaaauacaugaaugcaauauaucaugcccaaauccacuaccauucagagaauaccgaccacaaaccgaaggaguaagcaaucuaguaggacuaccagauaauauaugcuuacaaaaaacaucaaaucaaauccucaaaccaaaauuaauaucuuauacccuaccaguaguaggacaaagcgguaccugcauaacagacccacuacuagcuauggaugaaggauacuuugcuuacagccaccuagaacgaauaggaaguuguaguagaggaguaucaaaacaaagaauaauaggaguuggcgaagucuuagauagaggcgacgaaguaccaucacucuucaugacaaauguauggacacccccaaauccaaauacaguauaccacuguuccgcaguauacaauaaugaauucuacuacguauuaugcgcaguaagcacaguaggagauccaauacuaaauaguacauacuggucaggaucacuaaugaugacaagauuggcaguuaaaccaaaaucaaacggaggaggcuacaaucaacaccaacuagcacuaagaaguauagaaaaagguagauaugacaaaguaaugccauacggucccucaggaauaaaacaaggugacacacuauauuuuccagcagucggauuucucguaagaacagaauuuaaauauaaugauucaaacugcccaauuacaaaaugccaauauucaaaaccagaaaacuguagacuauccaugggaauaagaccaaacucucauuacauacuaagaucaggacuccucaaguauaacuuaucugauggagaaaaccccaaaauagucuuuauagaaaucucagaccaacgcuuaagcauagguucaccaucaaaaguauacgauagccuaggccaaccaguauuuuaccaagcaucauuuaguugggacacaaugauaaaauucggugauguucaaacaguaaaucccuuagucgucaauuggcgagauaacacaguaauaucuagacccggacaaagccaauguccacgauuuaacacauguccagaaauauguugggaaggcgucuauaacgacgcguucuuaauagacagaauaaacuggauaucagccggaguauuccuugacagcaaucaaacagcagaaaacccaguauuuacagucuucaaagauaaugaaauacuauaucgagcucaacuagcuagcgaagacacaaaugcacaaaaaaccauaaccaauugcuucuuacuaaaaaacaaaauauggugcauaucacuaguagaaauauacgauacgggagauaacgucauacgaccaaaacucuucgcaguaaaaauaccagaacaauguacauaa

SEQ ID NO: 1239 - RNA, 1650 nt, Artificial Sequence
  derived and/or modified CDS sequence (opt6) from Nipah henipavirus__AAX51853__H1N1-HA(1-17)_G(70-602)
augaaagcaaucuuagucguacucuuauacacauucgcgaccgcaaacgcacaaaacuacacaagaagcacugacaaucaagcaguaauuaaagacgcccuacaaggaauacaacaacaaauaaaaggacucgcagacaaaauagguacugaaauaggccccaaagucagucuaauagacaccucaucaacaaucacaauaccugcaaauaucggccuauuaggaucaaaaauaucacaaucaacugccucaaucaacgaaaacguaaacgaaaaauguaaguucacacuuccaccucucaaaauacacgaauguaauauaucaugccccaacccacuaccauuucgagaauacagaccucaaacagaaggaguuucuaaccuaguuggcuuaccaaauaacauaugucuucaaaaaacuuccaaucaaauacuaaaaccaaaacuaauaucauacacccuaccagucguuggccaaucaggaacauguauaacagauccacuauuagcaauggacgaaggauacuucgcauacucacaccuagaaagaauaggaucuuguucaagagguguaucaaaacaaaaaauaauaggaguaggagaaguucuagaccgaggagacgaaguaccaucgcuauucaugacaaaugucuggacaccacccaacccaaauacaguauaucacugcagugccguauacaacaaugaauuuuacuauguccuaugcgcagucucaacaguaggagacccaauccuaaacuccacauacuggucaggaagucuuaugaugacucgucucgcagucaaaccaaaguccaacgacggaggauauaaccaacaucaauuagcccuaagaagcauagaaaaaggaagauacgacaaagucaugccauacggccccucaggaauuaaacaaggagauacauuauauuucccagcaguaggauuucuaguacgaacagaauucaaauacaacgauucaaauugccccauaacaaaaugccaauacaguaaaccagaaaacugucgacuuagcaugggaauacgaccaaacucucacuauguacuaagaucuggccuccuaaaauauaaucuaucagacggugaaaaccccaaaauaguauucauagaaauauccgaccaaagauuauccauaggaucaccaucaaaaauauaugacuccuuaggucaaccagucuuuuaccaagcaucuuuuuccugggacacaaugauaaaauucggagauguacaaacaguaaacccucuaguuguaucuuggagagacaacacaguaauaucacgcccuggccaaucacaaugcccacgcuucaacacauguccagaaauaugcugggaaggcguauacaacgacgccuuucucauagacagaauaaacuggauaucagccggaguauuccuagacuccaaucaaacagcagaaaauccaguauuuacuguauucaaagauaacgaaauauuguacagagcacaacuagcaagugaagauaccaacgcccaaaaaacaaucaccaacugcuucuuauuaaaaaacaaaauauggugcaucucacuaguagaaauauaugauacaggcgacaauguaaucagaccaaaauuauucgcaguaaaaauacccgaacaaugcacauaa

SEQ ID NO: 1240 - RNA, 1650 nt, Artificial Sequence
  derived and/or modified CDS sequence (opt6) from Nipah henipavirus__AEZ01397__H1N1-HA(1-17)_G(70-602)
augaaagcaaucuuagucguacucuuauacacauucgcgaccgcaaacgcacaaaacuacacucguucaacagacaaucaagcaaugaucaaagacgcacuacaauccauucaacaacaaauaaaaggcuuagcagacaaaauuggcacagaaauaggaccaaaaguaucacuaauagacaccagcaguacaauaacaaucccugccaacauaggccuauuaggaucaaaaauaucacaauccacagcauccauaaaugaaaauguaaacgaaaaaugcaaauuuacacuaccaccacuaaagauucacgaaugcaauauaucuugcccaaauccacuaccauucagagaauauaaaccccaaaccgaaggagucuccaaucucgucggccuaccuaacaacaucugcuuacaaaaaacauccaaccaaauauuaaaacccaaauuaauaucauacacacuaccaguaguaggacaauccggaacaugcauuacagacccacuacucgccauggacgaaggauauuuugcauauucacacuuagaaaagauaggaucauguucaagaggagucucuaaacaaagaauaaucggcgucggugaaguccuagauagaggagaugaaguccccucgcuauucaugacaaacgucuggacaccaucaaauccuaauacaguauaccauuguucugcagucuauaacaacgaauucuacuaugucuuaugcgcaguaucaguagugggagacccaauccuaaacuccacauacuggucaggaagccuaaugaugacacgacuagcugugaaaccaaaaaauaacggugaaucauacaaccaacaucaauucgcauuacgaaacauagaaaaaggcaaauaugacaaaguaaugccauauggaccauccggaauaaaacaaggcgacacauuauauuuccccgcaguaggauuucuuguucgaacagaauuuacauacaacgauucaaacuguccaauagccgaaugccaauacucuaaacccgaaaauugccgucuaagcaugggaauacgaccaaacucacacuacauacucagaucaggauuacuaaaauacaaucucucagacgaagaaaacuccaaaauaguauucaucgaaauaucugaucaacgacuauccauuggcucacccucaaaaauauaugacucacuaggacaaccaguauucuaccaagccaguuuuucuugggacaccaugaucaaauucggagacguucaaacaguaaacccccucguaguaaauuggcgagacaauacaguaaucuccagaccaggucaaucgcaaugucccagauuuaacaaauguccagaagucuguugggaagguguauacaaugaugcauuucuuauagacagaauaaauuggauaucagcaggaguuuuuuuagacucuaaccaaaccgcagaaaacccagucuucacaguauucaaagacaaugaaguacuauaccgcgcacaauuagcaagcgaagacacaaacgcacaaaaaacuauaacuaauugcuucuuauuaaaaaacaaaauaugguguauaucucucguagaaauauacgauacaggagacaacguaaucagaccaaaauuauucgcaguaaaaauaccagaacaaugcacauaa

SEQ ID NO: 1241 - RNA, 1656 nt, Artificial Sequence
  derived and/or modified CDS sequence (opt6) from Hendra henipavirus__NP_047112__H1N1-HA(1-17)_G(70-604)
augaaagcaaucuuagucguacucuuauacacauucgcgaccgcaaacgcacaaaauuacacaagaacuacagauaaucaagcccucauaaaagaaucccuacaauccguucaacaacaaaucaaagcccuuacagacaaaauaggaacagaaauagguccaaaaguaucacuaauugauacaucuucaacaauuacaauaccagcaaacauaggcuuauuaggaucuaaaauaucacaaucaacaagcucuauuaaugaaaacguaaaugauaaauguaaauucacccuaccaccacucaaaauacacgagugcaauauuucaugucccaacccauuaccauuuagagaauaucgaccaauaucucaaggaguuucagacuuaguaggacuaccuaaccaaauaugcuuacaaaaaacaacuucaacaauauuaaaaccacgccucauaucauacacacucccaauaaauacaagagaaggaguaugcauaaccgauccccuacuugcaguugacaacggcuucuucgcuuacucccacuuagaaaaaauagguucuugcacaagaggaauagccaaacaaagaauaauaggaguaggagaaguccuagacagaggagacaaaguaccaucaauguucaugacaaauguauggaccccaccaaacccaucuacaauacaccauugcucaucaaccuaccacgaagauuucuauuacacacuaugcgcaguaagccacguuggugaccccauacuaaacucaacuucauggacagaaucccuaagucuaauaagauuagcaguccgaccaaaauccgacucaggugauuauaaccaaaaauauauagcuaucacaaaaguagagcgaggaaaauacgauaaaguaaugccauauggaccauccggaauaaaacaaggcgauacacucuauuucccagcuguaggcuuccuaccacgcacagaauuucaauacaacgacucaaauuguccaauaauccacugcaaauacagcaaagcagaaaauugcagauuaaguaugggaguaaacaguaaaucacauuacauacuaagaucaggauuacuaaaauacaaccuaucucucggaggagacauaauauuacaauuuaucgaaauagcagacaaccgauuaacaaucggcucaccuuccaaaaucuacaacucacuaggucaaccaguauuuuaccaagcaaguuacucaugggacacaaugauaaaacuuggagacguagacacagucgauccccuacgcguacaauggagaaacaauucuguaauauccagacccggacaaucacaauguccacgauuuaacguaugucccgaaguaugcugggaaggaacauauaacgacgccuucuuaauagaccgacuaaacuggguaucugccggcguauaccuaaacucaaaccaaacagcagagaacccuguauuugccguauucaaagacaacgaaauacucuaccaaguaccauuagcagaagaugacacaaaugcacaaaaaacaauaacagacugcuuccuacuagaaaacgucauuuggugcauaucacuaguagaaauauacgacacaggagacagcguaauccgaccaaaacuuuuugcagucaaaauacccgcucaaugcuccgaaucauaa

SEQ ID NO: 1242 - RNA, 1656 nt, Artificial Sequence
  derived and/or modified CDS sequence (opt6) from Hendra henipavirus__AEB21225__H1N1-HA(1-17)_G(70-604)
augaaagcaaucuuagucguacucuuauacacauucgcgaccgcaaacgcacaaaacuacacaagaacaacugacaaccaagcacugauuaaggaauccuuacaaucaguacaacaacaaauaaaagcacuaacagauaaaauuggaaccgaaauaggcccaaaaguaucacuuauugacacuucauccacaaucacaauaccagcaaacauaggacuccuaggcucuaaaauaucucaaucaaccuccuccauaaacgaaaauguaaacgauaaauguaaguucacacuacccccuuuaaaaauacacgaaugcaauauaucauguccaaacccacuuccauuccgagaauacagaccuauaucacaaggaguaucagaucuaguaggauuaccaaaccaaauaugucuccaaaaaacuacauccacaaucuuaaaacccagauuaaucucuuauacauuaccaauaaauacaagagaaggcgucugcauaacagaucccuuacuagcugucgacaacggcuucuucgcauauucacaucuagaaaaaauaggaagcugcaccagaggaaucgccaaacaacgaauaauaggaguaggcgaaguucuagaccgaggcgacaaaguuccaucaauguucaugaccaacguauggacccccccaaaccccucaacaauacaccauugcucaucaacuuaucacgaagacuucuacuacacccuaugcgcaguaucacacguaggagacccaauacuaaacucaacaagcuggaccgaaagucucucacuaauuagacuugcaguaagaccaaaaagcgauuccggcgauuacaaucaaaaauauauagcaauaacaaaagucgaacgaggaaaguacgauaaaguaaugccauacggaccaucaggcauaaaacaaggagauaccuuauauuucccagcagucggcuuuuuaccuagaaccgaauuccaauacaacgacucuaacugcccuauaauucacuguaaauauuccaaagcagaaaacugucgauuauccaugggagucaacuccaaaucacacuauauucuaagaaguggacuauuaaaauacaacuuaucacuuggaggagacaucaccuuacaauuuauagaaauagcagauaauagacucacaauagguagcccuuccaaaauauacaauucacuaggccaaccagucuuuuaucaagcaucauacucaugggauacaaugauaaaacuaggcgacguagacacaguagacccuuuaagaguccaauggagaaauaacucaguaauaucacgacccggccaaucccaaugcccacgauucaacguuuguccggaaguauguugggaaggcacuuacaacgacgcauuccuaaucgauagacucaacuggguaucugcugguguauacuuaaauuccaaucaaacagcagaaaauccaguauucgcagucuuuaaagacaacgaaauacuauaucaaguuccccucgcugaagacgacaccaacgcacaaaaaaccauaacagacuguuuuuuauuagaaaacguaauauggugcaucucuuuaguagaaauauacgauacaggagacucaguaauacguccaaaauuauucgcagucaaaaucccagcucaaugcuccgaaucauaa

SEQ ID NO: 1243 - RNA, 1656 nt, Artificial Sequence
  derived and/or modified CDS sequence (opt6) from Hendra henipavirus__AEB21216__H1N1-HA(1-17)_G(70-604)
augaaagcaaucuuagucguacucuuauacacauucgcgaccgcaaacgcacaaaacuacacacgcacaaccgauaaccaagcacuaauaaaagaaucauuacaaucaguccaacaacaaaucaaagcccucaccgauaaaaucggcacagaaauaggccccaaaguuucacucauagauacaucuaguaccauaaccaucccagcaaacaucggucuauuaggaucaaaaauaucacaaucaacauccucaauaaaugaaaaugucaacgauaaaugcaaauucacauuaccaccauuaaaaauccacgaaugcaacauaucaugucccaacccacucccuuucagagaauaccgcccaauaucccaaggagucucagacuuagucggauuaccaaaccaaaucugccuacaaaaaaccacaucuacaauacuaaaaccaagauuaaucucuuacacauuaccaauaaauacccgagaaggagucugcauuacugaccccuuacuagcuguagacaacggcuuuuuugcauacagccacuuagaaaaaaucgguuccugcacuagaggaauagcaaaacaaagaaucauaggaguaggcgaaguacuagaucgaggcgauaaaguaccaucaauguuuaugacaaaugucuggacacccccaaacccauccaccauccaccauugcucaucaacauaucacgaagacuucuauuacacacuuugcgcaguaagccacguaggugaccccauucuuaauucaacaucuuggacagaaucccuuucacucaucagacuagcaguaagaccaaaauccgacucaggagacuauaaccaaaaguauauagccauaaacaaagucgaaagaggaaaauacgauaaaguaaugccauauggcccauccggcauaaaacaaggagacacccuauauuuuccagccguaggcuuccuaccucgcacagaauuccaauauaacgauuccaacugcccaauaauacauugcaaauauucaaaagcagaaaacugcagacuaucaaugggaguaaacucgaaaucacacuacauccuuagaucaggccucuuaaaauacaaucuaucccuaggcggagacaucauauuacaauuuauugaaauagcagacaauagacuaacaauaggaucaccaucaaaaauauacaacucucuaggccaaccaguauucuaucaagcaucuuauucaugggauaccaugaucaaacuaggugaugucgauacuguugaucccuuacgaguucaauggagaaacaacuccguuauaucacgucccggucaaucacaaugucccagauucaaugucugcccugaaguauguugggaaggcacauauaacgaugccuucuuaauagaucgacuaaauuggguaucagcaggcguauaucuaaacucaaaccaaacagcagaaaacccaguauuugcaguuuucaaagacaaugaaauacucuaccaaguaccauuagcagaagaugacacaaaugcacaaaaaacuauaacagacuguuucuuauuagaaaacguaauaugguguauaaguuuaguagaaauauacgacaccggagacucuguaauaagacccaaacucuuugcaguaaaaauaccagcccaaugcucugaaucauaa

SEQ ID NO: 1244 - RNA, 1656 nt, Artificial Sequence
  derived and/or modified CDS sequence (opt6) from Hendra henipavirus__AEB21206__H1N1-HA(1-17)_G(70-604)
augaaagcaaucuuagucguacucuuauacacauucgcgaccgcaaacgcacaaaacuacacacgcacaaccgacaaccaagcacuaauaaaagaaagucuacaaucuguccaacaacaaauaaaagcacuaacugauaaaauuggaacagaaauaggccccaaaguaucucuaaucgacacaucaucaacaauaacaauaccagccaacauaggacuauuaggcucaaaaaucagccaaucaaccagcaguauaaaugaaaaugucaaugacaaaugcaaauucacauuaccaccucuaaaaauacacgaaugcaacaucucaugcccaaacccacuaccauuuagagaauacagaccaauaucccaaggaguaucugaccuaguaggccuaccuaaccaaauaugucuacaaaagacaacaucaacaauuuuaaaaccaagacuaauauccuacacauuaccaauuaacacaagagaaggcgucugcauaacagauccacuauuagccgucgacaauggauucuucgcauacagccaccucgagaaaauaggcucaugcacaagaggaauagccaaacaacgcauaauaggaguaggugaaguauuagaccgaggagacaaaguaccaagcauguuuaugacaaacguauggacuccuccaaacccaucaacaauacaccacuguucaaguacauaccaugaagacuuuuacuacaccuuaugugcaguaucacacgugggagaccccauacucaauucuacuucauggacagaaucacuaucucuaauaagauuagcaguaagaccaaaauccgacucuggaaacuauaaccaaaaauacauagcaauuacaaaaguagaaagagguaaauacgacaaaguaaugccauauggaccaucagguaucaaacaaggcgauacucuauacuucccagcagucggauuucuuccaagaacagaauuucaauacaaugacaguaacuguccaauuauacauuguaaauacucaaaagcagaaaauuguagacucucaaugggagucaacaguaaaucccacuacauauuacguucaggacuucuaaaauauaacuuaucauuaggcggcgacauaauccuacaauucauagaaauagccgacaacagacuuacaauaggaucaccaagcaaaauuuauaacucauuaggucaaccuguauucuaccaagcaucauacuccugggacacuaugauuaaauuaggagacauagacaccguagacccacuuagaguacaauggaggaacaacucuguaauauccagaccuggacaaagccaaugucccagauucaauguaugucccgaagucuguugggaaggaacguacaaugacgcauuccuaauagaccgccuaaacuggguaucagcuggaguauaccuaaacucaaaucaaaccgcagaaaaccccguauucgcaguauucaaagauaaugaaauauuauaccaaguaccucuagcagaagacgacacaaacgcacaaaagaccauaaccgacugcuuccugcuagaaaaugucaucuggugcaucagcuuagucgaaauauacgauacaggagacagcguaauacgacccaaacuauuugcagucaaaauaccagcacaaugcucugaauccuaa

SEQ ID NO: 1245 - RNA, 1656 nt, Artificial Sequence
  derived and/or modified CDS sequence (opt6) from Hendra henipavirus__AEQ38052__H1N1-HA(1-17)_G(70-604)
augaaagcaaucuuagucguacucuuauacacauucgcgaccgcaaacgcacaaaacuauacucgaaccacagacaaucaagcccuuauaaaagaaucacuacaaucaguacaacaacagaucaaagcauuaacagauaaaauaggaacagaaauaggaccaaaaguaucucuaaucgacacaucaucaacaaucacuauaccagcaaacaucggauuacuaggaucaaaaaucucccaaucaaccucauccauaaacgaaaauguaaacgauaaaugcaaauuuacauuaccaccccucaaaauacacgaaugcaacauaucuugcccuaaccccuuacccuuccgcgaauaucgccccauaucacaagguguuucugauuuaguaggauuacccaaucaaauaugucuacaaaaaacaacaucaacaauucuaaaaccaagauuaaucucauacacacuuccaauaaauaccagagaaggaguaugcauaacagauccacuacucgccguagauaacggcuucuuugcauauucacaucuagaaaaaauaggaucauguacccguggaauagcuaaacaaagaauaauuggcgucggagaaguacuagauagaggagacaaagucccuuccauguucaugacaaauguauggacuccaccaaacccaucaacaauacaccauugcuccucuaccuaccacgaagacuuuuacuacaccuuaugcgcagucucccauguaggcgacccaauacugaacucaacaucauggacagaaucacuaucucuuauacgauuagccgucagacccaaaucugacucaggagauuauaaucaaaaauacauaacaauaacaaaaguugaaagaggaaaauacgauaaagucaugcccuacggaccauccggaauaaaacaaggagacacacuauauuucccagcaguaggcuucuuacccagaaccgaauuucaauacaacgacucaaauugcccaauaauccacuguaaauauucaaaagcugaaaauugccgauuaagcaugggaguaaauaguaaaucacacuacauauuaagaucaggacuucuaaaauacaaccuaucauuaggaggcgacauaauauuacaauuuauagaaauagcagacaaccgcuuaacaaucggaucaccaaguaaaauauacaacucacuagggcaaccaguuuuuuaccaagcaucauacucaugggacacaaugauaaaacuaggagauguagauacaguagaccccuuaagaguacaauggagaaacaacucaguuauaucucgaccaggacaaucacaaugcccuagauucaauguaugcccagaaguauguugggaaggaacauauaacgacgcauuuuuaauagaucgccuaaauuggguuucagcuggcguauacuuaaacucaaaucaaacagcugaaaaccccguauuugccguauucaaagacaaugaaauauuauaucaaguaccucuagcagaagacgauaccaaugcacaaaaaaccauuaccgacuguuuucuacucgaaaacguaaucuggugcauaucauuaguugaaauauacgauacaggcgacucagucauaaggcccaaauuauucgcaguaaaaauaccagcucaaugcuccgaaagcuaa

SEQ ID NO: 1246 - RNA, 1656 nt, Artificial Sequence
  derived and/or modified CDS sequence (opt6) from Hendra henipavirus__AEQ38115__H1N1-HA(1-17)_G(70-604)
augaaagcaaucuuagucguacucuuauacacauucgcgaccgcaaacgcacaaaacuacacaagaacaacugacaaccaagcccuaauaaaagaaucccuacaaucaguacaacagcaaauaaaagcauuaacagacaaaauaggaacagaaauaggaccaaaaguuagucuaauugacacgucaaguacaauaacaauuccagcaaauauaggucuauuaggaucuaaaauaucucaaucuaccucuucaauaaacgaaaacguaaacgauaaaugcaaauucacuuuaccuccacuuaaaauccacgaaugcaacauaucaugucccaacccccuacccuucagggaauacagaccuauaucacaaggaguaagugaucuaguaggccuaccaaaccaaauaugucuucaaaaaacuaccucaacaauccucaaaccacgacuaauauccuauacauuaccaauuaacacucgcgaaggaguauguauaacagacccacuucuagcaguagacaacggauucuucgcauacucucacuuagaaaaaauaggauccuguaccagaggaauagccaaacaaagaauaauaggaguaggcgaaguuuuagauagaggagauaaaguaccuuccauguucaugacaaauguauggacaccacccaacccaagcacaauacaucacugcucaagcacauaucaugaagacuucuacuacaccuuaugcgcaguaucucauguaggcgacccuauacuaaacuccacuucauggacagaaucacuaagccuaaucagacucgcuguacgaccuaaaucagauaacggagacuauaaccaaaaauauaucgcgaucaccaaagucgaaagaggaaaauacgauaaaguuaugccuuacggacccucuggaauaaaacaaggagacacacuauacuucccagcaguaggcuuucucccccgaaccgaauuccaauacaaugauucuaauugcccuaucauacauugcaaauacuccaaagcagaaaacuguagguuauccaugggaguaaauucuaaaucccacuauauccucagaucaggcuuacuaaaauacaacuuaucacuagguggcgauauuauauuacaauucauagaaauugcagacaacagauuaacuauuggaucacccucaaaaauauauaauucacucggacaaccaguauucuaccaagcaucguacucaugggacaccaugauaaaauuaggcgacgucgauacaguagacccacuaagaguacaauggagaaauaauuccgucauaucacgaccaggccaaucucaauguccaagauucaauguauguccagaagucugcugggaagguacauacaacgacgcuuuccuaauagauagauuaaacuggguaucagcaggagucuaccuaaacagcaaccaaacagcugaaaauccuguauucgcaguauuuaaagacaacgaaauacuauaccaaguaccacuagcagaagaugacacaaaugcacaaaaaacuauaacagacuguuuccuacuagaaaacguaauaugguguaucucacucgucgaaauauacgacacaggagacagcguaauaagaccaaaacuauuugccguaaaaaucccagcacaaugcucagaauccuaa

SEQ ID NO: 1247 - RNA, 1656 nt, Artificial Sequence
  derived and/or modified CDS sequence (opt6) from Hendra henipavirus__AEQ38108__H1N1-HA(1-17)_G(70-604)
augaaagcaaucuuagucguacucuuauacacauucgcgaccgcaaacgcacaaaacuauaccagaacaacugacaaucaagcacuaauaaaagaaucacuacaaucuguacaacaacaaauaaaagcacuaacagauaaaaucggaacagaaauaggucccaaaguaagucuaauugauacaucaucuacuauuaccauucccgcuaacauaggacuacuaggaucuaaaaucucacaauccacgucaucuauaaacgaaaauguaaaugacaaauguaaauucacccuaccaccacucaaaauucacgaauguaauauaucauguccuaacccacuuccauucagagaauauagacccauaucccaaggaguauccgaccuuguaggauuacccaaucaaauaugccuccaaaaaacaacgucaacaauacuaaaaccacgauuaauaucuuacacacuacccauaaacacacgagaaggaguaugcauaacagauccccuauuagcugucgacaauggauuuuucgcuuacucucaccuagaaaaaauagguucuugcacaagaggcaucgcaaaacaaagaauaaucgguguaggagaaguccucgacagaggagauaaaguaccaucaauguucaugacuaauguuuggacuccaccaaacccauccaccauacaccauugcuccagcacauaucaugaagacuuuuacuauacacuaugugccguaucacacguaggagaucccaucuuaaacagcacaagcuggacagaaucacuaucacucauaagacuagcaguuagacccaaaucagauucaggugacuauaaucaaaaauacauaacaauaaccaaagucgaaagaggaaaauacgauaaaguaaugccauacgggcccucagguauaaaacaaggcaacacauuauauuucccagcaguaggauuuuuaccaagaacagaauuucaauacaacgacucaaacugucccaucauacacuguaaauauuccaaagcagaaaauugcagacuaagcaugggaguaaacuccaaaagccacuacauacucagaucaggacuacuaaaauacaaccuaucacucggaggugauauaauccuacaauuuauugaaauagccgacaaccgucuaacaaucggaucaccaucaaaaaucuacaacucacuaggacaacccguauucuaucaagcuagcuauucaugggacacaaugauaaaauuaggagacguagacacagucgacccccuacgaguccaauggcgaaacaacucagucauaucaaggccuggacaaucgcaauguccacguuuuaacguaugccccgaaguuugcugggaaggaacauacaaugacgcauuucuuaucgauagacucaauuggguauccgccggcguauacuuaaacucaaaccaaacagcagaaaacccugucuuugcaguauucaaagauaaugaaauacuuuaccaaguaccacucgcagaagacgauacaaacgcacaaaaaacaauaacagauuguuuucuacuugaaaaugucauaugguguauaucacuaguagaaaucuaugauacaggagacucaguaauuagaccuaaacuauuugcaguaaaaauaccugcacaaugcuccgaaucguaa

SEQ ID NO: 1248 - RNA, 1656 nt, Artificial Sequence
  derived and/or modified CDS sequence (opt6) from Hendra henipavirus__AAV80426__H1N1-HA(1-17)_G(70-604)
augaaagcaaucuuagucguacucuuauacacauucgcgaccgcaaacgcacaaaacuacacaagaacaacagauaaccaagcucuaauaaaagaaucacuacaauccguccaacaacaaaucaaagccuuaacugauaaaaucggaacagaaauaggacccaaaguauccuuaauagacacuucaucaacaauaacuauaccagcuaacauaggacuauuaggcagcaaaauuucucaaugcacaucuucuaucaaugagaacguaaaugacaaaugcaaauucacccuuccuccauuaaaaauucacgaaugcaacauaucgugucccaauccacucccauuuagagaauaucgaccaauaucccaaggcguaucagaucuaguaggccucccaaaccaaauuugccuacaaaaaacaacaucuacaauacuaaaaccccgcuuaauaagcuauacucuaccaauaaacacacgcgaaggcguaugcaucacugauccccugcucgcaguagauaacggguucuucgcauauagccaccuugaaaaaauaggaucauguacuagaggaauagcaaaacaaagaauaauaggaguaggagaaguccucgauagaggagauaaagugcccagcauguucaugacaaacguauggacaccaccaaacccuucaacaauccaccacuguucaucaacauaccaugaagacuucuauuauacacuaugcgcaguaucucacguaggagacccaauauuaaacuccacaagcuggacagaaucacuaucccucauaagacuugcuguaagacccaaaucugacuccggagacuacaaccaaaaauacauagcaauaacaaaaguagaaagaggaaaauacgauaaagucaugccauacggaccaaguggaauaaaacaaggagacacacuauacuucccagcuguaggauuccucccccgaacagaauuucaauacaacgauucuaacuguccaauaauacacugcaaauauuccaaagcugaaaacugccgauuaucaauggggguuaacucaaaaucacacuacauacuaagaucaggacuacuaaaauacaaccuaucacucggcggagacauaauacuccaauuuauugaaauagccgacaaucgacuaacaauaggaucaccaaguaaaaucuacaacucacuaggucaaccagucuucuaucaagccuccuacucaugggacaccaugauaaaacuaggagauguagacaccguagauccauuacgcguacaauggagaaauaacuccgucaucagucgacccggacaaucacaauguccacgauuuaauguaugcccagaaguauguugggaaggcucauauaaugaugcauuccuaauagacagacuuaauuggguaucagcaggaguauaccuaaauucaaaccaaacagcagaaaacccuguauuugccguauucaaagacaaugaaauuuuauaucaaguuccacuagcagaagacgacaccaacgcacaaaaaacaaucacugacugcuuucuacuagaaaacguuaucugguguauaaguuuaguagaaaucuaugauacaggagacucaguaauaagacccaaacuauucgccgucaaaaucccagcacaaugcucagaaagcuaa

SEQ ID NO: 1249 - RNA, 1614 nt, Artificial Sequence
  derived and/or modified CDS sequence (opt11) from Nipah henipavirus__AAK50553__H1N1-HA(1-17)_F(27-546)
augaaagcgaucuuggucgugcucuuguacacguucgcgaccgcgaacgcgauccuccauuacgaaaaacuaucaaaaaucggccucgucaaaggcguaacccgcaaauacaagauaaaaucaaacccgcuaaccaaagacaucguuaucaaaaugaucccaaacgucuccaacaugucccaaugcaccggcuccgucauggaaaacuacaaaacccgccuaaacggaauccucaccccaaucaaaggagcacucgaaauuuauaaaaauaacacccacgaccuagucggcgacguccgccuagcaggcguaaucauggcaggcgucgccaucggcauagccaccgccgcacagaucaccgccggugucgcccucuacgaagcaaugaaaaacgcugacaacaucaacaaacucaaauccuccaucgaauccacaaacgaagccgucguaaaacuacaagaaaccgccgagaaaaccgucuacguacucacagcccuccaagacuacauaaacaccaaccuaguacccaccauagacaaaaucuccuguaagcaaaccgaacuuagccuagaccucgcccucucuaaguaccucucagaccuccucuucguauuugguccuaaucuacaagacccgguauccaacucaaugacaauccaggccaucucccaagccuucggcggcaacuacgaaacccuccuacgcacccucggcuacgcaaccgaagacuuugacgaccuccuagaauccgacuccaucacaggccagaucauuuacgucgaccucucauccuacuacaucauaguaagagucuacuuccccauccucaccgagauccaacaagccuacauacaagaacuccuaccggucuccuucaacaacgacaauuccgaguggaucagcauaguccccaacuucauccucguacgaaacacccucaucagcaacaucgagauuggcuucugccucauaaccaaacgcuccgucaucugcaaccaagacuacgcaacccccaugaccaacaacaugcgugaaugccucacaggcagcaccgaaaaaugccccagagagcucguagucuccucccacgucccacgauucgcccuauccaacggcguccucuucgcaaacugcauuuccguuaccugccaaugccaaaccacaggacgggccaucucgcagucuggcgaacagacccuacuaaugaucgacaacacaaccugccccaccgccgucuuaggcaacgucaucaucucccugggaaaauaccucggcuccguuaacuacaacuccgaaggcaucgcaaucggaccucccgucuucaccgauaaagucgacaucuccagccaaaucuccuccaugaaucaaucucuccaacaaucaaaagauuacauaaaagaagcccaacgacuccucgacaccguaaaccccucacucaucagcauguuaucaaugaucauucuguacguacucuccaucgcgucccuaugcauaggccugaucaccuucaucucauucauaaucgucgaaaagaaacguaacaccuacucccgccuagaagaccgccgcguacgccccaccuccucuggggaccucuacuacaucgguaccuaa

SEQ ID NO: 1250 - RNA, 1614 nt, Artificial Sequence
  derived and/or modified CDS sequence (opt11) from Nipah henipavirus__AEZ01388__H1N1-HA(1-17)_F(27-546)
augaaagcgaucuuggucgugcucuuguacacguucgcgaccgcgaacgcgauacuucacuacgaaaaacuguccaaaaucggccuugucaaagguaucacccguaaauacaaaauaaaaucaaacccccucaccaaagauaucgucauaaaaaugauccccaacgucucgaacaugucccaauguaccggcuccgucauggaaaacuacaagacccgccucaacgguauccuaaccccaauaaaaggcgcccuagaaaucuacaaaaacaacacccacgaccucgucggcgacguacgccucgccggcgucaucauggccggcguagccaucgggaucgccacagcagcccaaaucaccgccggcguugcccucuacgaagcaaugaaaaacgccgacaacaucaacaagcucaaaagcucaaucgaauccaccaacgaggccguagucaagcuccaggaaacagccgagaaaacugucuacguccuaaccgcacuccaagacuauauaaauaccaaccuaguaccaaccaucgacaaaaucagcugcaaacagacagaacugucccucgaccuagcccucagcaaauaccugagcgaccuacucuuuguauucggacccaaccugcaggaccccguuucaaacucaaugacaauacaagccaucucccaagccuucggcgggaacuacgaaacacuacugagaacccucggguacgccaccgaagacuucgacgaccuuuuagaauccgauagcauaaccggacaaaucaucuacguugaccuaagcggcuacuacauaauaguccgcguuuacuucccaauacucacagaaauucaacaagccuacauacaagaacuacucccaguguccuucaacaacgacaacuccgaauggaucuccauaguccccaacuucauccucgucaggaauacacuaaucagcaacauagagaucggcuucugccuaaucaccaaacguagcguaaucugcaaccaagacuacgccaccccuaugacuaacaacaugcgcgaaugccucaccgguucaaccgaaaagugcccacgagagcucgucgucuccucccacgugccccgcuucgcccucagcaacggcguccucuucgcaaacugcaucuccgugacaugccaaugccagacaaccggccgagccauuagccagucaggcgagcagacccuccucaugaucgacaacacaaccugcccaaccgccguccugggcaacgucauaauaucacugggcaaauaccucggaucugucaacuacaacucugaaggaauagccauaggcccacccguauucaccgauaaaguagacaucagcucccaaaucuccagcaugaaccaaagccuccaacaauccaaagacuacauuaaagaagcacaacgccuccucgacaccgucaaccccucauuaaucucaaugcucuccaugaucauccuauacguacugagcaucgccucccucugcaucggacuaaucaccuuuaucuccuucaucaucgucgaaaagaaacgcaacaccuacucgcgccuagaagaccgccgcguccgccccaccuccuccggugaccuguacuacaucggcaccuga

SEQ ID NO: 1251 - RNA, 1614 nt, Artificial Sequence
  derived and/or modified CDS sequence (opt11) from Nipah henipavirus__AAY43915__H1N1-HA(1-17)_F(27-546)
augaaagcgaucuuggucgugcucuuguacacguucgcgaccgcgaacgcgauccuacacuacgaaaaacucuccaaaauaggccuaguuaaaggcaucacucgcaaauacaagauuaaauccaacccccucacaaaagacaucgucaucaaaaugauccccaaugucuccaacaugucccaaugcaccggcuccgucauggaaaacuacaaaacucgccucaacggaaucuuaacccccaucaaaggcgcgcucgagaucuacaaaaauaacacccacgaccugguaggcgacguccgacuugcuggagucauaauggccggcguagccaucggcaucgcaaccgcggcccaaaucaccgcagggguugcccucuacgaggccaugaaaaacgccgacaacauaaacaaacuaaaauccagcaucgaauccacuaacgaagccguaguaaaacuccaggaaacggccgagaaaaccgucuacguacuuacagcccuucaagauuacauaaauacgaaccucguccccaccaucgacaagaucucaugcaaacaaaccgaacucucccuugacuuagcgcucuccaaauacuccagcgaccuacucuucguauucgggccuaaccuccaagacccaguaagcaacuccaugaccauucaagcaauaucacaagccuucgggggcaacuaugaaacccuacucagaacccucggcuacgccaccgaaggcuucgacgaccuucuagaaucagacucuaucacuggccagauaaucuaugucgaccuaagcggauacuauauuauuguucgcgucuacuuccccauccucaccgaaauccagcaagccuacauacaggaacuccuccccgucagcuucaacaacgacaacuccgaauggaucuccaucguccccaacuucauccucguucgcaacacccuaauaucaaacaucgaaaucggcuucugccuaaucaccaaacgcuccgucauaugcaaccaggacuacgccaccccaaugaccaacaacaugcgcgaaugccucacaggcuccaccgagaaaugcccacgcgagcuaguugucuccucacacgucccccgcuucgcauuaucaaacggcguacucuucgcaaauugcaucuccgucacaugccaaugccaaaccacaggccgugccauaucacaaucaggcgaacaaacccuucucaugaucgacaauacaaccugccccaccgccguacucgguaaugucaucaucucacugggcaaauaccuaggaucagucaacuacaacucagaaggcaucgccaucggcccacccgucuucaccgauaaagucgacaucuccucucaaaucuccuccaugaaccaaucacuccaacagagcaaagacuacaucaaagaagcacaacgacuccucgacaccgucaaccccucccuaauauccaugcucucgaugaucauccucuacguacucuccauagccagccucugcaucggccuaaucaccuucaucagcuucauaauaguagaaaagaaacgcaacacauauucccgacuggaagacagacgcguccgucccacauccucaggagaccuguacuacaucggaaccuaa

SEQ ID NO: 1252 - RNA, 1614 nt, Artificial Sequence
  derived and/or modified CDS sequence (opt11) from Nipah henipavirus__CAF25496__H1N1-HA(1-17)_F(27-546)
augaaagcgaucuuggucgugcucuuguacacguucgcgaccgcgaacgcgauccuacacuaugaaaaacuaagcaaaauaggacucguaaaaggagucacccgcaaauacaaaauuaaaucuaacccacucacaaaagacauagucaucaagaugauccccaacgucuccaacaugucccaaugcaccggcucugucauggaaaacuacaagacccgacuaaacggcauccucaccccaauaaaaggcgcccuagaaauauauaaaaacaacacccacgaccuagucggcgauguucgacucgccggcgucaucauggccggcguagccaucggcaucgccacggcagcccaaaucaccgccggcgucgcccuauacgaagccaugaaaaacgccgacaacauaaacaagcucaagagcucgaucgaaucaacaaacgaagccgucgugaaacuacaagaaacagcagaaaagacaguauacguccucaccgcccuacaagacuacaucaacaccaaccuggucccaaccauagauaaaaucucaugcaaacaaacagaacucucacucgaccucgcccuaucuaaguaccuaucagaccuccucuucgucuucggccccaaccuacaagacccagucuccaacuccaugaccauccaagccauuucccaagccuucggcggcaacuacgaaacacuacuaagaacccucggcuacgcgaucgaagacuucgacgacuuacucgaaucagacuccaucaccggccaaaucaucuacgucgaccucuccucuuacuacaucaucguacgcgucuacuucccaauccucacagaaauccaacaggccuacauccaggaacuacuccccgucuccuucaacaacgacaacuccgaauggaucuccaucgucccgaacuucauccuaguccgcaacacucucauuuccaacauagaaaucggcuucugccucaucaccaagcgcucagucaucugcaaccaagacuaugcaacacccaugaccaacaacaugcgugaaugccucaccgguuccaccgaaaaauguccccgugaacucgucguaagcucccacgucccccgcuuugcccuauccaacggcguacucuucgccaacugcaucucaguaaccugccaaugccaaaccacgggucgagcaaucucacaaucaggcgaacaaacacuccuaaugaucgacaacacaaccugcccgaccgccgucuuaggaaacguaauaaucucacucggaaaguaccucgguuccgucaauuauaacucagaaggcaucgcuauaggucccccaguauuuaccgacaaggucgacauaaguagccaaaucuccuccaugaaccaaucccuacaacaauccaaagacuacauaaaggaagcccagcgacugcuagacaccgucaacccaucgcuaaucuccaugcuguccaugaucauccuauacguccugucaaucgccucucugugcaucggccucaucaccuucauaucuuucaucaucgucgagaaaaagcgaaacaccuacucacgacucgaagaccgacgcguccgcccuaccuccucgggugaucuuuacuacauaggcaccuga

SEQ ID NO: 1253 - RNA, 1614 nt, Artificial Sequence
  derived and/or modified CDS sequence (opt11) from Nipah henipavirus__AAM13405__H1N1-HA(1-17)_F(27-546)
augaaagcgaucuuggucgugcucuuguacacguucgcgaccgcgaacgcgauacuacacuacgaaaaacucucaaaaaucggccuugucaaaggcgucacccgaaaauacaagaucaaauccaacccccucaccaaggacauugucauaaaaaugauacccaacgucuccaacaugagccaaugcaccggaagcgucauggaaaauuacaaaacacgucucaacgguauccucaccccgaucaaaggggcccuagagaucuacaagaacaacacacacgaccucgucggugauguacgacucgcaggcgucaucauggccggcgucgccaucgggaucgccaccgccgcccaaaucaccgcuggcgucgcucuuuaugaagccaugaaaaaugccgauaacaucaacaaacuuaaauccucuauugaauccaccaacgaggccgucgucaaacuccaagaaacagcugagaaaaccguguauguccucaccgcccuccaagacuacaucaacacaaaucucgucccuacaauagacaagaucucaugcaaacaaacagaacucucucuagaccuagcccucuccaaauaccuuagcgaccuacuauucguauucggacccaaccuccaagaccccgucuccaacucaaugacaauacaagccaucagccaggccuucggcggcaacuacgaaacacuccuucgcacccucggcuacgcuacagaagacuucgacgaccuacucgaauccgacucaaucaccggccaaaucaucuauguggaccucuccuccuacuacaucaucguccgcguauacuuuccaauccuaaccgaaauccaacaggccuauauacaagaacuccucccgguuuccuucaacaaugacaacuccgaauggauauccaucgucccaaacuucauccucguccgcaacacccuaaucagcaacaucgaaaucggcuucugccuuauaaccaaacgauccguuaucugcaaccaagacuacgccaccccaacaaccaacaacaugagagaaugccucaccggcuccaccgaaaaaugccccagagaacucgucguauccucccacguaccacgguucgcacuaucaaacggcguucuauucgccaacugcaucuccguaaccugccaaugccaaaccaccggccgcgcaauaucucaauccggcgaacaaacccuacuuaugaucgacaacacaaccugccccaccgccguccuaggcaacgucauaaucucccucggcaaauaccuaggcucagucaacuacaacagcgaaggcaucgccaucggaccucccgucuucacagacaaagucgacauauccucccaaaucuccaguaugaaccaaagccuacagcaaucaaaagacuacaucaaagaagcacaacgccuccucgacaccgucaaccccucccucauaucaaugcucucaaugaucauccucuacguccuuuccaucgccucccucugcaucggccuuaucaccuucauaucauuuaucaucgucgaaaagaaaagaaacaccuacucccgccucgaagaccgcagaguccgccccaccucgucaggcgaccucuauuauaucggcacauaa

SEQ ID NO: 1254 - RNA, 1614 nt, Artificial Sequence
  derived and/or modified CDS sequence (opt11) from Nipah henipavirus__CBM41033__H1N1-HA(1-17)_F(27-546)
augaaagcgaucuuggucgugcucuuguacacguucgcgaccgcgaacgcgauccuccacuacgaaaaacucucaaaaauaggccuuguuaaaggcguaacccgcaaauacaaaaucaaauccaauccacugacaaaagacaucgucauaaaaaugaucgccaacguguccaacaugucucaaugcacaggcuccgucauggaaaacuacaaaacccgcuuaaacgguaucuuaaccccaaucaaaggagcacucgaaaucuacaaaaacaacacccacgaccuagucggcgacguccgacucgcuggcgucauaauggccggggucgcaaucggcaucgccaccgccgcccagauaaccgccggcgucgcacucuacgaagcaaugaaaaaugccgacaauaucaacaagcuaaaaucuagcaucgaauccaccaacgaagccgucgucaaacugcaagaaaccgccgagaaaaccgucuacguucucacagcccuacaagacuacaucaacaccaaccucguucccaccauagacaaaauaucgugcaaacaaaccgaacucucccucgaccucgcacuuuccaaauaccucucagaccuucucuucguguucggcccaaaccuccaagacccagucuccaacuccaugaccauacaagccauaucacaagccuucggaggcaacuacgaaacacuacuacgcacacucggcuacgccaccgaagacuucgacgaccuccuugaauccgacucgauuacaggccaaaucaucuacgucgaccuaagcagcuacuacauaaucguccgcgucuacuuccccauccucaccgaaauccaacaagccuacauccaagaacugcuccccgucagcuucaacaacgacaacucagaauggaucucuauuguaccuaauuucauccucguccgcaacacccucaucuccaauaucgaaauagguuucugccuaaucacuaaacgauccgucaucugcaaucaagacuacgccacccccaugacaaacaacaugagggaaugccucaccgggucaaccgagaaaugcccccgcgaacucgucgucuccucccacgucccucgauucgcgcucuccaacggaguccuauucgcaaacugcaucucuguaaccugccaaugccaaaccaccggacgcgcaaucucacaauccggugaacaaacucuccuaaugaucgauaacacaaccugccccaccgcuguacucggcaaugucauuauaucccuuggcaaauaccuaggaucggucaauuacaacuccgagggcauugccaucggcccucccguauucaccgacaaagucgacaucuccucccaaaagucauccaugaaccaaucucugcaacaauccaaagacuacaucaaggaagcccaacgccuccuagacaccgucaaccccucccucaucucaaugcucuccaugaucaucuuauacguacuaucuaucgccucccucugcaucggucucauuaccuucaucucuuucaucaucgucgaaaagaaacgaaacaccuacucacgccucgaagaccgccgcgugcgccccaccuccagcggagaccuuuacuacaucggcaccuaa

SEQ ID NO: 1255 - RNA, 1614 nt, Artificial Sequence
  derived and/or modified CDS sequence (opt11) from Nipah henipavirus__AEZ01396__H1N1-HA(1-17)_F(27-546)
augaaagcgaucuuggucgugcucuuguacacguucgcgaccgcgaacgcgauacuccacuacgaaaaacuuuccaaaaucgggcucgucaaagggaucacgcggaaauacaaaaucaaaucgaacccgcucaccaaagacauaguaauaaaaaugauuccaaacgucucaaacaugucccaaugcaccggcucagucauggagaacuacaaaacccgacucaacggaauacuaaccccaaucaaaggcgcccucgaaaucuacaaaaacaacacacacgaccuaguuggcgacguacgacucgcaggcguaauuauggccggcgucgcaauaggcauugccaccgccgcccaaaucaccgccggaguagcacuauacgaagccaugaagaacgccgacaacaucaauaaacucaaaucuucaaucgaaagcaccaacgaagcagucgugaaacuacaagaaaccgcagagaaaaccgucuacguucuuaccgcacuacaagauuacauaaacaccaaccucguuccaacaaucgacaaaaucucaugcaaacagacugaacuaagccucgaccucgcucucucaaaauaccucuccgaccuccuauucgucuucggccccaaccuccaagaccccguaagcaacuccaugacaauccaagcaaucucucaagccuucggcggcaacuacgaaacccuucuccgcacucuaggcuacgccaccgaagacuuugacgaccuacuagaauccgacucgaucaccggacaaaucaucuacgucgaucucuccggcuacuacauuauaguuagggucuacuucccaauacuuaccgaaauccaacaagcauacauccaggaacuccuccccgucucuuucaacaacgacaacucggaauggauaagcaucguccccaacuucauccucguccguaacacccucauaucaaacaucgaaaucggcuucugccuaauuacuaaacgcuccgucaucugcaaccaagacuacgccaccccaaugacaaacaacaugcgcgaaugccucaccggcucaaccgaaaaaugcccgagagaacucgucgucucaucucacgucccacgcuucgcgcuauccaacggcguacuuuuugccaacugcauuuccguuacaugccagugccaaacuaccgguagagcaaucucccaaagcggagaacaaacccuccucaugaucgacaacaccacaugccccaccgccguccucggaaacgucaucaucagccucggcaaauaccucggcuccgucaacuacaauucagaaggcaucgccauaggcccucccguauucaccgacaaagucgacaucuccucccagaucucauccaugaaucaaucgcuucagcaauccaaagauuacaucaaggaagcccaacgccuccucgacaccgucaaccccucccucaucucaaugcucucaaugaucauccuauacguccucucaaucgccagccucugcaucggccuaauaaccuucaucucauucauuauaguagaaaagaaacgcaacaccuacuccagacuagaggaccgccgagucagacccaccucauccggagaccucuacuacaucggaaccuaa

SEQ ID NO: 1256 - RNA, 1614 nt, Artificial Sequence
  derived and/or modified CDS sequence (opt11) from Hendra henipavirus__NP_047111__H1N1-HA(1-17)_F(27-546)
augaaagcgaucuuggucgugcucuuguacacguucgcgaccgcgaacgcgauccuccauuacgaaaaacuaucaaaaaucggacuuguaaaaggcaucaccagaaaauacaaaauaaaauccaacccucucaccaaagauauugucaucaaaaugauccccaacguauccaacgucuccaaaugcacgggaacagucauggaaaacuacaaaagcagacuaaccggcauccucucaccgaucaagggcgcaaucgaacucuacaacaacaacacccacgaccucgucggcgacguuaaacucgccggcguagucauggccggcaucgcaaucggcauagccacggccgcccaaaucaccgccggagucgcacuuuacgaagcaaugaaaaacgccgacaacauaaacaagcuaaaauccuccaucgaaagcacaaacgaagccgucgugaaacuccaagaaaccgccgagaaaaccgucuacguucuaaccgcccuucaagacuacaucaacaccaaccucguccccacaauugaccaaauuucaugcaaacaaacagaacucgcccuagaccuagcccucagcaaauaccucuccgaccuccucuucgucuucggccccaaccuucaagacccuguauccaacagcaugacuauacaggccaucucccaagcauucggcggcaacuacgaaacccuacuccgcacccucggguacgccacagaagauuucgacgaccuccucgaauccgacagcaucgccggccaaauaguuuacguagaccuguccuccuacuacaucaucguacgcgucuacuucccaauccuaaccgaaauucaacaagccuacguacaagaacuccuacccgucucauucaacaacgacaacuccgaauggaucucaaucgucccaaacuucguccucauacgaaacacacugaucuccaacaucgaagucaaauacugccucaucacaaagaaaagcgucaucugcaaccaagacuacgccacacccaugaccgccuccguccgagaaugccuaacagguuccaccgacaaaugcccccgcgaauuagucgucuccagccacguccccagguuugcacucuccggcggcguccuauucgccaacuguaucuccguuaccugccaaugccagacuaccggcagagccaucucccaauccggagaacaaaccuuacucaugauugacaacacaaccugcaccaccgucguccuagguaacaucaucaucucccucgggaaauaccuaggcuccaucaacuacaacuccgaauccauugcggucggaccucccgucuacaccgacaaaguagacaucuccucccaaaucagcuccaugaaccaaucccuccaacaaucuaaagacuacauaaaagaagcccagaaaauccucgacaccgucaaccccucccucauuuccaugcucuccaugaucauccucuacguucuauccauagccgcccucugcauuggccuaaucaccuucaucuccuucguuaucgucgaaaagaaacgcggaaacuacucucgucucgacgaccgccaaguccgccccgucagcaauggcgaccuuuacuacaucggaaccuag

SEQ ID NO: 1257 - RNA, 1614 nt, Artificial Sequence
  derived and/or modified CDS sequence (opt11) from Hendra henipavirus__AEB21233__H1N1-HA(1-17)_F(27-546)
augaaagcgaucuuggucgugcucuuguacacguucgcgaccgcgaacgcgauccuccacuacgaaaaacucuccaaaauaggccucguuaaaggcauuacccggaaauacaaaaucaaaucgaacccccucaccaaagacaucgucaucaaaaugaucccuaacguaucaaacgucuccaaaugcaccgguaccgucauggaaaacuacaaaucccgacucaccgguauccucagcccuauuaaaggagccaucgaacuauacaacaauaacacccacgaccucgucggcgaugucaaacuggcaggcguugucauggccggaaucgccaucggcaucgcuacagccgcacaaauaaccgccggcguagcucuauacgaggccaugaagaacgccgauaacaucaacaaacuaaaaucauccauagaauccaccaaugaagccguagucaaacuccaagaaaccgcagaaaagaccguuuacguccucaccgcacuccaagacuacauuaacaccaaccuuguccccaccaucgaccaaauuuccugcaaacaaaccgaacucgcacucgaccucgcacucuccaaguaccuauccgaccuccuguucguauucggccccaaccuccaagaccccguauccaacuccaugaccauccaagccaucucccaagccuucggcggcaacuacgaaacccugcuacgaacgcucggcuacgcaaccgaagacuucgacgaucuccucgaauccgacuccaucaccgggcaaaucgucuacgucgaccugucauccuacuacaucauaguacgaguauacuuccccauccucaccgaaauccaacaagccuauguccaagaacuccuccccgucucuuuuaacaacgacaacagcgaauggaucucgaucguccccaacuucguccucauacgcaacacucuaauauccaauaucgaaguaaaauacugccucauaacaaagaaauccgucaucugcaaccaagauuacgccacaccuaugaccgccuccguacgagaaugccucaccggcucaaccgacaaaugcccccgugaacucgucguauccagccacguaccacgcuucgcccucucaggcggaguacuguucgcuaacugcaucucuguaacaugccaaugccaaacaaccggacgcgccaucucccaaucaggcgaacaaaccuugcucaugauugacaauaccacgugcacuacagucguucuaggaaacaucaucaucagccucggaaaauaccucggcuccaucaacuacaacucugaguccauugccgucgggccacccgucuacaccgacaaagucgacaucuccucucaaaucucauccaugaaccaaucccuacaacaguccaaagacuauaucaaagaagcccagaaaauccucgacaccgugaaccccucacuaaucucaaugcuaucuaugaucauccucuacguccuauccaucgcugcccucugcaucggccucauaaccuucaucagcuucguaauuguagaaaagaaacgcggcaacuacucacggcuagacgaccgccaaguccgacccguaucaaacggcgaccucuacuacauaggcaccuaa

SEQ ID NO: 1258 - RNA, 1617 nt, Artificial Sequence
  derived and/or modified CDS sequence (opt11) from Hendra henipavirus__AEQ38114__H1N1-HA(1-17)_F(26-546)
augaaagcgaucuuggucgugcucuuguacacguucgcgaccgcgaacgcgggaauccuccacuacgaaaaacucucaaaaauugggcucgucaaaggcaucacccgaaaauacaaaaucaaauccaacccucucaccaaagacaucgucaucaaaaugauccccaacgucagcaacgucuccaaaugcaccggcacagucauggaaaacuacaaaucccgccucaccggaauacuaucuccuaucaaaggcgccaucgagcucuauaacaacaacacccacgaccucgucggcgaugucaaacuagccgggguuguaauggccggcauagccaucggcaucgcaaccgcugcacaaaucaccgccggugucgcccucuaugaagccaugaaaaacgccgacaacauaaacaaacuaaaaucuucaaucgaguccaccaacgaagccgucguaaaacuccaagaaaccgccgaaaaaaccguuuacguccucaccgcccugcaagacuacaucaacacaaaccucguacccaccaucgaucaaaucucaugcaaacaaaccgaacucgcucucgaccucgcccucuccaaauaccuuuccgaccuccucuucguauucggccccaaccugcaagaccccgucuccaacucaaugaccauucaagccauaucacaagccuucgggggcaacuacgaaacacuccuccgcacccucggcuacgcaaccgaagacuucgacgaccuacucgaauccgauucaaucacaggccaaauaguauacgucgaccuguccucauacuacaucaucguccgcgucuacuucccaauccucaccgagauccaacaagcauacguccaggagcuccuaccugucucuuucaacaaugacaacucagaauggauaucgauaguccccaacuucguccuuauccgcaacacacucaucagcaacaucgaagucaaauacugccuaaucaccaaaaaaucgguaaucugcaaccaagacuacgccacccccaugaccgccucaguucgagagugccuaacaggcuccacagacaaaugccccagagagcucgucguaucaucccacguaccucgcuucgcccuuuccggcggcguccuuuucgccaacugcaucuccgucaccugccaaugccaaacaaccggucgcgcgaucucacaaucgggcgaacaaacccuucuuaugauugacaacacaaccugcacaaccgucguacucggcaacaucaucaucucgcucggaaaauaccuaggcuccaucaacuacaacagcgaaagcaucgcugucggcccccccgucuacaccgacaaaguagacauuuccucccaaaucuccuccaugaaccaaucccuccaacaaagcaaagacuacaucaaagaagcccaaaaaauuuuagauaccgucaaccccucccucaucucaaugcuaucaaugauaauccuguacguacuguccaucgccgcccucugcaucggucucaucaccuucaucucauucauaauaguagaaaaaaaacgcggcaacuacucucgucucgacgaccgccaaguccgccccgucucaaacggugaccucuacuacaucggcacauga

SEQ ID NO: 1259 - RNA, 1614 nt, Artificial Sequence
  derived and/or modified CDS sequence (opt11) from Hendra henipavirus__AAB39505__H1N1-HA(1-17)_F(27-546)
augaaagcgaucuuggucgugcucuuguacacguucgcgaccgcgaacgcgauccuccacuacgaaaaacuuuccaaaaucggccucgucaaaggcaucacccgaaaauacaaaaucaaaagcaacccccuuacaaaagauaucgugaucaaaaugaucccuaacgucuccaaugucucaaaaugcaccggaaccgucauggaaaacuacaaaucccgccuuaccggaauacucucccccaucaaaggcgcaaucgaacucuacaacaacaacacacaugaccucgucggugacguaaagcucgccggcguggucauggccggcauagccaucgguaucgcaacagccgcccaaaucacagccggaguagcacucuacgaagccaugaagaacgcagacaacaucaacaaacuaaagucaaguaucgaauccaccaacgaagcuguugugaaacuccaagaaaccgcagagaaaaccgucuacguccucacagcacuccaagacuacaucaacaccaaccuuguccccaccaucgaccaaaucuccugcaaacaaacugaacuagcccucgaccucgcccucuccaaauaccuccucaucugcucaugcuucggccccaaccuacaagaccccguuuccaacagcaugaccauccaagcuauaucccaagcauucggcggaaacuacgaaacccuacuucguacacucggcuacgccacagaagacuucgacgaccuccucgagucagacuccaucaccggccaaaucgucuacgucgaccucucuuccuacuacaucaucguacgcguauacuuccccauccugacagaaauacaacaagcauacguccaagaacuucuccccguuuccuucaacaacgacaacucagaauggaucagcaucguuccaaacuucguacucauacgcaacacccucaucuccaacauagaagucaaauacugccuaaucaccaagaaauccgucauuuguaaccaggacuacgccaccccaaugaccgcgucaguccgagaaugccucaccggaucuaccgacaaaugcccccgagaacucguugucuccagccacgucccgcgcuucgcccuauccggaggaguacuauucgccaacuguauaucaguaaccugccaaugccaaacuaccggccgcgcaaucucccaaucgcgcgagcaaacccuccucaugaucgacaacacaaccugcacaaccgucguccucggcaacauaauuauaucucucccaaaauaucuaggaucuaucaaacugcagguacuccgagcccuucugcuaggccaccaauccauacagaccaaaguugauauauccagccaaaucuccucaaugaaccagucccugcaacaauccaaagacuacauaaaagaagcccagaaaauccuagacaccgucaacccaucccucauauccaugcucucaaugaucauccucuacguccucuccaucgccgcgcugugcaucggacucaucacuuucaucagcuucgucaucgucgaaaagaaacgcggcaacuacucccgccuugacgaccggcaaguacggcccgucucaaacggcgaccuauacuacaucggaacguaa

SEQ ID NO: 1260 - RNA, 1650 nt, Artificial Sequence
  derived and/or modified CDS sequence (opt11) from Nipah henipavirus__AAK50554__H1N1-HA(1-17)_G(70-602)
augaaagcgaucuuggucgugcucuuguacacguucgcgaccgcgaacgcgcaaaacuacacccgaucaacugacaaccaagccgucaucaaagacgcacuccaagguauccaacaacaaaucaaaggccucgccgacaaaauuggaaccgaaaucggccccaaagucagccucaucgacaccucaucaaccauaaccauacccgccaacauugggcuccucggcuccaaaauuucccagagcaccgccucaaucaacgaaaacgucaacgaaaaaugcaaguucacccucccaccccucaaaauccacgaaugcaacaucuccugccccaacccccuccccuuucgggaauaccgaccccaaaccgaaggcgucucuaaccucgucggccucccgaacaacaucugccuccagaaaacguccaaccaaauccucaaaccaaaacuuaucuccuacacccucccggucguaggccaaagcggaaccuguauuaccgacccccuccucgcaauggacgaaggcuauuuugcauacucccaccucgaacgaaucggaucaugcagccgaggcguauccaaacaacgaaucaucggcguuggcgaaguacuagaccgaggcgacgaggucccaucccucuuuaugacuaacgucuggacuccucccaaccccaacaccgucuaccacugcuccgccguauacaacaacgaguucuacuacguccucugcgcagucagcacagucggugaccccauccuaaacuccaccuacuggucaggcucacucaugaugacuagacuagccguaaaacccaaauccaacggcggaggcuacaaccaacaucaacucgcccuccgaagcaucgaaaaggguagauacgacaaagucaugcccuacggccccuccggcaucaagcaaggcgauacccucuacuuuccagccgucggauuccucguccgcaccgaguucaaauacaacgacucuaauugccccaucaccaaaugucaauacucaaagcccgaaaacugccgccucuccaugggcauccgucccaacucccacuacauccuccgauccggccuucuuaaguacaaccucucugacggagaaaaccccaaaguaguauucaucgaaaucucagaccaacgccucagcaucggcuccccauccaaaaucuacgacucccucggacaacccgucuucuaccaagcaaguuucucaugggacacaaugaucaaguucggggacguccugacaguaaacccccuagucgucaacuggagaaauaacaccgugaucucacgccccggccaaucccaaugcccccgcuucaauaccugccccgaaaucugcugggaaggugucuacaacgacgcuuuccuuauagaccgcaucaacuggaucuccgcaggaguguuccucgacuccaaccaaaccgccgaaaaccccguguuuacaguauucaaagacaacgaaauccucuaccgcgcccaacuagccuccgaggacacuaacgcgcagaaaaccaucaccaacugcuuccuccucaaaaacaagauauggugcaucucccuaguugaaaucuacgacacuggcgacaacgucauccgaccuaagcuguucgcaguuaaaaucccagaacaaugcaccuaa

SEQ ID NO: 1261 - RNA, 1650 nt, Artificial Sequence
  derived and/or modified CDS sequence (opt11) from Nipah henipavirus__AEZ01389__H1N1-HA(1-17)_G(70-602)
augaaagcgaucuuggucgugcucuuguacacguucgcgaccgcgaacgcgcaaaacuacaccagaucaaccgacaaccaagcaaugaucaaagacgcccuccaaagcauccaacaacaaauuaaaggccucgccgacaaaaucggaacugagaucggccccaaaguuucccucauugacaccuccucaacaaucaccaucccagcgaacaucggacuacugggcuccaaaaucucacaauccacagccuccauaaacgagaacgucaacgaaaaaugcaaguucacacucccgccacuaaaaauacacgaaugcaacauauccugccccaacccccuccccuuccgcgaauacaaaccccaaaccgaaggcgucucgaaccucgucgggcuaccaaacaacaucugccuccaaaagaccucgaaccaaauacucaagcccaaacuuaucagcuacacccuccccguagucggccaaagcggaaccugcaucaccgacccccuccucgccauggacgagggcuacuucgcauauucccaccuagagaaaaucggcuccugcagccgcggcguaucgaaacaacgaauaauaggaguaggagaaguacucgaccgaggcgacgaagugcccucccuuuucaugaccaacguguggacacccucaaaccccaacacagucuaccacugcagcgcggucuacaacaacgaguucuacuacguccuaugcgcagucucaguagucggagaccccauacuaaacucuaccuacugguccggcucccucaugaugacccgccucgccguaaagccgaaaaacaacggcgaauccuacaaccaacaccaauucgcucuccgaaacaucgaaaaagguaaauaugacaaagucaugcccuacggucccuccgguaucaaacaaggcgacacccucuacuucccagccgucggcuuccucguccgaaccgaguucaaauacaacgacuccaacugucccaucgccgaaugucaauauucaaaacccgaaaacugccgacucuccaugggcauccgcccaaauucucacuacauccuccgcuccggucuccucaaauacaaccuauccgaugaagaaaacucgaaaaucgucuucauugaaaucuccgaccaacgccuauccaucggcucgcccucaaagaucuacgauucccuaggccaaccggucuucuaccaagccuccuucucaugggacaccaugaucaaauucggcgacguccaaacugucaacccacucgucguaaacuggcgcgacaacaccgucaucucaagacccggacaaucccaaugcccccgcuucaacaaaugcccagaaguaugcugggaaggcgucuacaacgacgccuuccucauagaucgcauaaacuggaucucagcgggaguuuuccuggacuccaaucaaacagcagaaaaccccguauucacugucuucaaagacaacgaaguucuauaucgugcccagcuugccuccgaagacacaaacgcacagaaaacaaucaccaacugcuuccugcucaaaaacaaaaucugguguaucucccucgucgaaauauaugacacaggcgacaacgucauacgcccaaaacuguucgccgucaaaauccccgagcaaugcaccuaa

SEQ ID NO: 1262 - RNA, 1650 nt, Artificial Sequence
  derived and/or modified CDS sequence (opt11) from Nipah henipavirus__ACT32615__H1N1-HA(1-17)_G(70-602)
augaaagcgaucuuggucgugcucuuguacacguucgcgaccgcgaacgcgcaaaacuacacgcgcucaacugacaaccaagccaugaucaaagacgcccuacaaucgauacaacaacagaucaaaggccucgccgacaaaaucggaaccgaaaucgguccgaaagucucacuaaucgacaccucaucaaccaucacaauccccgcgaacaucggcuuacuaggcucaaaaaucucacagucaacagcaucaaucaaugaaaacgucaacgaaaaaugcaaguucacccugccuccccucaaaauccacgaaugcaacaucagcugccccaacccccuacccuuccgggaauacaagccccagacagagggcguaagcaaucuaguuggccuuccaaacaacaucugcuuacagaaaaccuccaaccaaauccuaaaacccaaacuuaucagcuacacacuccccguagucggacaaucaggaaccugcauaaccgacccccuucucgccauggacgaagguuacuucgccuacucccaccuagagaaaauaggcucaugcucacgcggagucuccaaacaacgcaucaucggagucggagaaguccuagaccgaggcgacgaaguccccagccucuucaugacgaacgucuggacaccgucgaaccccaacacaguguaccacugcagcgccguauacaacaacgaguucuacuauguccuaugcgccgucuccgucgucggagaccccguccuaaacuccaccuacugguccggcucccucaugaugaccaggcuggccguuaaacccaaaaacaacggcgaauccuacaaccaacaccaauucgcccuuagaaacaucgaaaaaggaaaauacgacaaagucaugcccuacggaccauccggaauaaaacaaggcgacacccuguacuucccagcugucggcuuccuaguucgaaccgaguucaaauacaacgauagcaacugccccaucgcugaaugucaguacuccaaaccugaaaacugccggcuauccaugggcauccgccccaacucacacuacauccuaagaucaggacuccucaaauacaaccucuccgacgaagaaaacucuaagaucgucuucauagaaaucucagaccaacgcuuaagcaucggcucuccauccaaaaucuacgacucacuaggacaacccgucuucuaccaagcauccuucucaugggacacgaugaucaaguucggcgacguacaaacagucaacccccuaguggucaacuggcgagauaacaccgucaucucucgaccuggacaaucccaaugcccacgauucaacaagugcccagaagucugcugggaaggaguauacaacgacgccuuccucauugaccguaucaacuggaucuccgcaggcgucuuccucgacucaaaccaaaccgcagaaaaccccguguuuaccgucuucaaagacaacgaaguccucuaccgcgcccaacucgcaagcgaagacaccaacgcccaaaagacaaucacaaacugcuuccuucuaaagaacaaaauauggugcaucucccuaguggaaauuuacgacaccggugacaacgucauccggcccaaacucuucgcagucaaaauccccgaacagugcaccuaa

SEQ ID NO: 1263 - RNA, 1650 nt, Artificial Sequence
  derived and/or modified CDS sequence (opt11) from Nipah henipavirus__CAF25497__H1N1-HA(1-17)_G(70-602)
augaaagcgaucuuggucgugcucuuguacacguucgcgaccgcgaacgcgcaaaacuacacccgaucuacugacaaccaagcagucauaaaagacgccuuacaaggaauacaacaacaaaucaaaggacucgccgauaaaaucggcacugaaauaggccccaaagucagcuuaaucgacacaucauccacaaucacaauccccgccaacauaggucuacuugguuccaaaaucucccaaucaacagccucuaucaacgaaaacguaaacgaaaaaugcaaauucacccuacccccacucaaaauacacgaaugcaacaucuccugccccaacccccuccccuuccgcgaauaccgaccccaaaccgaaggcgucuccaaccucgucggccucccgaacaacauuugccuccagaaaacuagcaaucaaauccuaaaacccaaacucaucucauacacacugcccgucguaggccaaucgggaaccugcauaaccgacccccuccuagccauggacgaaggcuacuucgccuacucccaccuagaacggauuggcagcugcucccgcggcgucucaaaacaacgaauaaucggcguuggagaaguacuugaccgcggggacgaaguaccaucucuauucaugaccaacguaugggcaccaccuaacccuaacaccguauaccacugcuccgccguauacaacaacgaguucuacuacguccucugcgcagucucaaccguaggcgaccccauccucaacuccacuuacugguccggcucucucaugaugacccggcucgccgucaaacccaaauccaacggcgguggcuacaaccaacaccaacucgcucuccgauccaucgaaaaaggucgauacgacaaagucaugccguacggcccguccggcaucaagcaaggcgacacgcucuacuuccccgcagucggcuuccucguccgcaccgaguucaaauacaacgacucaaacugccccauaacaaaaugccaauacuccaaacccgaaaacugucgccucagcaugggcauccgaccaaacucgcauuacauccuacgauccggacuacuaaaguacaaccucuccgacggggaaaaccccaaaguuguuuucaucgaaaucuccgaccaacgccuuagcauaggauccccguccaagaucuacgacucgcuaggccagccagucuucuaccaagccaguuucuccugggacaccaugaucaaauucggcgacguccucaccgucaacccacuggucgucaacuggagaaacaacacugucauaucaagaccaggacaaucacaaugcccccgcuucaauaccugccccgaaauaugcugggaaggcgucuacaacgaugcauuccucaucgaccgaaucaacuggaucagcgccggcgucuuccucgacagcaaccaaacagccgaaaacccagucuucaccgucuucaaagacaacgaaauccucuaccgagcccaacuugccucagaagacaccaacgcccagaaaaccaucacaaacugcuuucuccucaaaaacaaaaucugguguaucucccuggucgaaaucuaugacacuggcgauaacgucauucgccccaaacuauucgcaguaaaaauccccgaacaaugcacauaa

SEQ ID NO: 1264 - RNA, 1650 nt, Artificial Sequence
  derived and/or modified CDS sequence (opt11) from Nipah henipavirus__CBM41034__H1N1-HA(1-17)_G(70-602)
augaaagcgaucuuggucgugcucuuguacacguucgcgaccgcgaacgcgcaaaacuacacccgcuccaccgacaaccaagccgucauaaaagacgcacuccaaggcauccaacaacaaaucaaaggacucgccgacaaaaucggaacagaaaucggucccaaagucucucucauagacacauccucaacuauaaccauccccgccaacauaggauugcucggaucaaaaauaucgcaauccaccgccuccaucaacgaaaacgugaacgaaaaaugcaaauucacccuaccaccccuaaaaauccacgaaugcaacaucucaugccccaacccacugccauuccgcgaauaccgcccccaaacagaaggcguaucuaaucucgucggccugccagacaacaucugccuccagaagacguccaaccaaauccuaaaacccaaacucaucucauacacacuacccgucgucggccaauccgggacaugcaucacggacccccuccucgccauggacgaaggguacuucgcauacucacaccuagaacgcaucgguucaugcuccagaggcgucuccaaacagcgcaucaucggcgucggcgaaguccuggaccguggcgacgaaguacccucccuguucaugaccaacguauggaccccucccaaccccaacaccgucuaccacugcucagccgucuacaacaacgaauuuuacuacguccuuugcgcugucaguacuguaggcgauccuauccucaacucgaccuacuggucaggaucccucaugaugacgcgucuugcagucaaacccaaaucaaacggcggcggcuacaaccaacaccaacucgcccuacgcagcaucgaaaaaggccgauacgacaaagucaugccauacggucccuccggcauuaaacagggcgacacacucuacuuccccgccgucggcuuccucguuagaacagaguucaaauacaacgacucaaacugcccaauaacaaaaugccaauacucaaaacccgaaaauugccgccuauccaugggcauacgccccaacagccacuacauccuccgauccggccuacucaaauacaaccucucagacggcgaaaaccccaaaaucguauucaucgaaauauccgaccaacgacucuccaucggcucucccucgaaagucuacgacucacuaggacaaccagucuuuuaccaagcuagcuuuucaugggacaccaugaucaaguucggagacguacaaacaguuaacccucucguuguuaacuggcgcgacaacaccgucauaucccgacccggccaaucccaaugcccccgcuucaauaccugccccgaaaucugcugggaaggaguauacaacgacgccuucuuaaucgaccgaauaaacuggaucuccgccggcgucuuccucgacuccaaccaaacagccgaaaacccugucuucacuguauuuaaagacaacgaaauacuauaccgcgcccaacucgcaagcgaagacaccaacgcacagaaaacaauaaccaacugcuuccuccucaaaaauaaaauauggugcaucagccuggucgaaauuuacgacaccggagacaacgucaucagaccuaaacucuucgccgucaaaauccccgaacaauguacauga

SEQ ID NO: 1265 - RNA, 1650 nt, Artificial Sequence
  derived and/or modified CDS sequence (opt11) from Nipah henipavirus__AAX51853__H1N1-HA(1-17)_G(70-602)
augaaagcgaucuuggucgugcucuuguacacguucgcgaccgcgaacgcgcaaaacuacacacgauccacugacaaccaagcugucauaaaagacgccuuacaaggcauccagcaacaaauuaaaggccucgcagacaaaaucggcacugaaauaggccccaaaguaucccuaauagauaccuccuccacaauaacuauaccagccaacaucggucuucuagguucuaaaaucucacaauccaccgcaagcaucaacgaaaacguaaacgaaaaaugcaaauucaccuugccaccccuaaaaauccacgaaugcaauaucuccugccccaacccccuccccuuccgagaguacagaccccaaaccgaaggcgucucgaaccucgucggccucccgaacaacauaugucuacaaaagaccucaaaccaaauccuuaaacccaaacucauaagcuacacgcuccccguagucggccaaucaggcacgugcaucacagacccccuacucgcaauggacgaaggcuacuucgccuacucucaccuggaacgcaucggcuccuguucuagaggcguauccaaacagaaaauaaucggggucggcgaaguccucgaccguggagacgaaguccccucccuauucaugacaaacguauggaccccacccaaccccaacaccgucuaccacugcuccgcaguuuacaacaacgaguucuacuacguacucugugcagucuccaccguaggcgaccccauacucaacuccaccuauuggagcggaucccuaaugaugacccggcucgccgucaaaccaaaaucaaacgacggcggcuacaaccaacaccaacucgcccuacgcucaauugaaaaaggccgauaugacaaagucaugcccuacggucccucuggcauaaaacaaggagauacacucuacuucccugcagucggcuuucucguacgcacagaguucaaauacaacgacucaaacugccccaucacuaaaugccaauacuccaaacccgaaaacugccgccucuccaugggaauccgccccaacucccacuacguccuccgauccggacuccucaaauacaaccuauccgacggcgaaaaccccaaaaucguauucaucgaaaucuccgaccaacgccuaucaauuggaucacccucaaaaaucuacgauucucucggucaacccguuuucuaccaagccucauucucgugggacaccaugauaaaguucggagacgugcaaaccgucaacccacucgucguauccuggcgagacaacacagucauaucccgcccgggacaaucccaauguccccgcuucaauacaugccccgaaaucugcugggaaggcgucuacaacgacgcauuccucaucgaccgaaucaacuggaucuccgccggcgucuuccuagacucgaaccaaaccgcagaaaaccccgucuucaccgucuuuaaagacaacgaaauccucuaccgcgcgcaacuagccuccgaagacacaaacgcccagaaaaccauaaccaacugcuuccuccucaaaaacaaaaucuggugcaucucacucgucgaaaucuacgacaccggcgacaacguuauccgccccaagcuauucgccguuaaaaucccagagcaaugcacauga

SEQ ID NO: 1266 - RNA, 1650 nt, Artificial Sequence
  derived and/or modified CDS sequence (opt11) from Nipah henipavirus__AEZ01397__H1N1-HA(1-17)_G(70-602)
augaaagcgaucuuggucgugcucuuguacacguucgcgaccgcgaacgcgcaaaacuacacccgaagcaccgacaaccaagccaugauaaaagaugcccuucaauccauccaacaacaaaucaaaggccucgcagacaaaauagggaccgaaaucggacccaaagucucccuaaucgacaccuccucaaccaucacuauccccgcaaacaucggccuccuaggauccaaaaucucacaauccaccgcaagcauaaacgaaaacgucaacgaaaaaugcaaauucacccuaccaccccuaaaaauucacgaaugcaacaucucaugccccaauccccuaccauuccgcgaauacaaaccucaaaccgaagggguaucuaaccucgucggucuccccaacaacaucugccuccagaaaaccuccaaccaaauucucaaacccaaacuaauauccuacacacuccccgucguagggcaguccggcacaugcauaacggacccccuucucgccauggacgaaggcuauuucgcauacucccaucuggagaaaaucggcuccugcagccgcggcgucucgaaacaacgaaucaucggcguaggagaaguccucgaccgcggcgacgaagugccaagucucuucaugacaaacgucuggacccccuccaacccaaacaccgucuaccacugcuccgccguauacaauaacgaguucuacuacguccuaugcgcagugucugucgucggagacccgauucuaaacuccaccuacuggagcggcucacucaugaugacccgacucgcagucaaacccaaaaacaacggagaauccuacaaccaacaccaauucgccuuacguaacauagaaaaaggaaaauaugacaaggucaugccauacggccccuccggaaucaaacaaggcgacacccuauauuucccggccgucggauuucuaguccgcacugaguucacauacaacgacaguaacugccccauagccgaaugccaauauagcaaacccgaaaacugccgauuauccaugggaauccgacccaacucccacuacauccuccgcucagggcuccucaaauacaaccugagcgacgaagaaaacuccaaaaucgucuucaucgaaauauccgaccaacgccuaagcaucggcucacccagcaagauauaugacucccucggccaacccgucuucuaccaagcaucauucuccugggacaccaugauaaaauucggcgacguucaaacgguaaacccacucguaguuaacuggcgcgacaacacagucaucagccgccccggccaaucccaaugcccccgauuuaauaaaugccccgaagugugcugggaaggagucuacaacgacgccuuccugauagaccgcaucaacuggaucagcgcaggcgucuuccucgacuccaaccaaaccgccgaaaaccccgucuucacagucuucaaagacaacgaaguccuauaccgcgcacaacucgccucagaggacaccaacgcccagaaaaccaucaccaacugcuuccuucucaaaaacaaaauauggugcaucagccucgucgagaucuaugacacaggcgacaacgucauccgccccaaauuauucgccguaaaaaucccugaacaaugcacauaa

SEQ ID NO: 1267 - RNA, 1656 nt, Artificial Sequence
  derived and/or modified CDS sequence (opt11) from Hendra henipavirus__NP_047112__H1N1-HA(1-17)_G(70-604)
augaaagcgaucuuggucgugcucuuguacacguucgcgaccgcgaacgcgcaaaacuacacucgaacaacagacaaccaagcacuaauaaaagagucacuccaguccguccaacaacaaaucaaagcacuaacagacaaaauaggaaccgagaucggucccaaagucucccuuaucgacacauccuccaccauuaccaucccagccaauauuggccuacuuggcuccaaaaucucccaaucaaccucaucaauaaacgaaaacgucaacgacaaaugcaaauucacccucccaccccuaaaaauccacgagugcaacaucuccugccccaacccacuucccuuccgcgaauaccgucccaucucccaaggcgucuccgaccuuguaggccucccuaaccaaaucugccuacagaaaaccacaagcaccauacucaaaccccgacuaaucucauacacccuaccuaucaacacacgagagggcgucugcaucaccgauccacuacuagcuguugacaacggcuuuuucgccuacucccaccucgagaaaaucggaucaugcacucgcggcauagccaaacaacgcaucaucggcgucggagaaguccucgaccgaggcgacaagguucccuccauguucaugaccaacguuuggacacccccuaaucccucaaccauccaccacugcuccucaaccuaccacgaagacuuuuacuacacccucugcgcagucucccacgucggcgaccccauacuaaacuccaccuccuggacagaaucccucucccucauccgucuggccguccgccccaaaucagacagcggagacuacaaccaaaaguacaucgcgauaaccaaagucgaacgcggcaaguacgacaaaguaaugcccuacggccccuccggcaucaaacaaggagacacucuauacuucccagcaguaggcuuccuaccccggacugaguuccaauacaacgacucaaacugccccaucauacacugcaaauacucaaaagcagaaaacugccggcucagcaugggggucaacucuaaaagccacuacauacuccgauccggauuacucaaauacaaccuaucccuaggcggcgacauaauccuccaguucauugaaaucgcugacaaccgccuuaccaucggcagcccaucaaaaauauacaacucucuaggacaacccgucuucuaccaagccuccuacuccugggacaccaugaucaaauuaggagacgucgacaccguagacccgcuccgcguacaguggcguaacaacucugucaucucccgccccggacagucucaaugcccccgcuucaaugucugccccgaaguaugcugggaaggcacguacaacgacgcauuccucaucgaccgccuuaacugggucucagcaggcguauaccucaacuccaaccaaacugccgaaaaccccguuuucgccguuuucaaggacaacgaaauccuauaccaagucccccucgccgaagacgacaccaacgcccagaaaacaaucacggacugcuuccuccuagaaaacguaaucuggugcaucagcuuagucgagaucuacgacacaggcgauucagucauacgccccaaacuauucgcuguuaagauccccgcccaaugcuccgaaaguuag

SEQ ID NO: 1268 - RNA, 1656 nt, Artificial Sequence
  derived and/or modified CDS sequence (opt11) from Hendra henipavirus__AEB21225__H1N1-HA(1-17)_G(70-604)
augaaagcgaucuuggucgugcucuuguacacguucgcgaccgcgaacgcgcagaacuacacaaggaccaccgacaaccaagcccucauaaaggaaagccuacaauccguccaacaacaaaucaaagcacucaccgacaagaucggcaccgaaaucggacccaaggucucacuaaucgauaccucauccacaauaaccauaccagccaacaucgggcuacucggcucaaaaaucucccaguccacaagcuccauuaacgaaaacgucaacgacaaaugcaaguucacacucccgccccucaaaauccacgaaugcaacauauccugccccaacccccuccccuuccgugaauaccgcccgaucucucaaggugucucagaccucguaggccuccccaaccagaucugccuccaaaagacgaccucaacaauccucaaaccacgccuaaucuccuacacccuccccaucaacacccgagaaggagucugcaucaccgacccacuacucgccgucgauaacggcuucuuugccuacucacaccucgaaaagaucggauccugcacgcgcggcaucgcaaaacagcgcauaaucggcgucggcgaaguccucgaccgcggcgacaaagucccuagcauguucaugaccaacguauggaccccacccaaccccuccaccauccaccacugcagcaguacauaccacgaagacuucuacuacacccucugcgcugucucccacgugggagacccaauccucaauuccaccucauggaccgaaucgcucucccucauccggcuagccguucgccccaaauccgacuccggagacuacaaccagaaauacaucgcaauaacgaaagucgaaagaggcaaguacgacaaagucaugccguacggccccuccggaaucaaacaaggagacacccucuacuucccggccguaggauuccucccccgaaccgaauuucaauacaacgacucaaacugcccaauuauacacugcaaauacuccaaagccgaaaacugcagacuaucaaugggagucaacuccaaaucucacuacauacuccgcuccggacuccucaaauacaaccucucccugggcggcgacaucacacuccaauucaucgaaaucgccgacaaccgccucaccaucggcagccccucaaaaauauacaacucccucggacagcccgucuucuaccaggccuccuacucgugggauacaaugauaaaacucggcgacgucgacaccgucgacccccuucgaguccaauggcguaacaacucagucaucuccagacccggccaaagccaaugcccaagauucaacgucugccccgaaguaugcugggaaggaacauacaacgacgccuuccuuaucgaccgccucaacugggucucugccggcguauacuuaaacagcaaucaaaccgccgagaacccagucuucgcagucuuuaaagauaacgaaauccuauaccaagucccacucgcagaagacgacacaaacgcccagaaaacgaucacagacuguuuccuacuagaaaacgucaucuggugcaucagucucgucgaaauauacgacaccggcgacagcguaauacgccccaaacuuuucgccguaaagauccccgcucaauguucugaaucuuag

SEQ ID NO: 1269 - RNA, 1656 nt, Artificial Sequence
  derived and/or modified CDS sequence (opt11) from Hendra henipavirus__AEB21216__H1N1-HA(1-17)_G(70-604)
augaaagcgaucuuggucgugcucuuguacacguucgcgaccgcgaacgcgcaaaacuacacacgcaccacagacaaccaagcccuaaucaaagaaagccuacaaucuguacaacagcaaaucaaagcacuaacagacaaaauuggcaccgaaauuggccccaaagucucccucaucgauacauccucaaccaucacaauacccgccaacaucggccuucucggcucuaaaauaucccaaagcaccuccucuaucaacgaaaacguaaacgacaagugcaaguucacacuaccaccccucaaaauccaugaaugcaauauaucaugccccaacccccuccccuuuagagaguaccgcccaaucucccaaggcgucuccgaccuggucgggcuaccaaaccaaaucugccuccagaaaacaaccuccaccauacuaaaaccccgccuuaucagcuacacccuacccaucaacacacgagagggcgucugcaucaccgacccccuccucgccgucgauaacggcuucuucgccuacagucaccucgaaaagaucggaagcugcaccagaggcaucgccaaacaacgcaucaucggcgucggagaaguucuugaccgcggcgauaaaguacccagcauguucaugacaaacgucuggacaccacccaacccaucaaccauccaccauugcuccucgacuuaccacgaagacuucuacuacacccuaugcgcgguuucccacguaggagaccccauccuuaacuccacgucuuggaccgaaucacucucccucauccgacuggccguacgccccaaaucugacuccggcgacuacaaccaaaaauauauugcaaucaacaaagucgaaagaggaaaauacgacaaagucaugccuuauggcccaagcggcaucaaacaaggagacacacucuacuuccccgccgucggcuuccucccccggaccgaguuccaauacaacgacuccaacugcccgauaauccacugcaaauacagcaaagcugaaaacugcagacuguccaugggagucaacuccaaaagccacuacauccuccgcuccgggcugcucaaauacaaccuaucccuugggggcgacaucauccuccaauucaucgaaauagcugacaacagacucacaauaggaucccccuccaaaaucuacaacucccucggucagccagucuucuaccaagccuccuacuccugggacacgaugaucaaacuaggugacgucgacacagucgacccccuacgaguccaauggcgaaacaacuccgucauaucccgccccggccaaagccaaugcccacguuucaacgucugccccgagguauguugggaaggcaccuacaacgacgcauuccucauagaccgacucaacugggucuccgccggcguauaccucaacagcaaccaaacugccgaaaaccccgucuuugccgucuuuaaggacaacgaaauccucuaccaagucccccucgccgaggaugacacuaacgcccagaaaaccauaaccgacuguuuucuucucgagaacgucaucuggugcaucagccucgucgagaucuacgacaccggcgacuccgucauacgacccaaacucuucgcagucaaaaucccagcacaaugcucugaguccuag

SEQ ID NO: 1270 - RNA, 1656 nt, Artificial Sequence
  derived and/or modified CDS sequence (opt11) from Hendra henipavirus__AEB21206__H1N1-HA(1-17)_G(70-604)
augaaagcgaucuuggucgugcucuuguacacguucgcgaccgcgaacgcgcaaaacuacacccgaaccaccgacaaucaagcacucaucaaagaaucccuccaauccguccaacaacaaauaaaagcacuuacggacaagaucggaaccgaaauuggccccaaagucagccucaucgacacgagcuccacgauaaccauccccgccaacaucggccuccucggauccaaaauuucccaauccaccuccucaauaaacgaaaacguaaacgauaaauguaaauucacccuacccccauuaaaaauccacgaaugcaacauaucaugcccuaacccacuccccuuucgagaauaucgacccauaagccaaggugucagcgaccuaguaggccuccccaaccaaauaugccuccagaaaaccacauccaccauccuaaaaccacgccucauaucuuacacccuacccauaaacacucgagaaggggucugcauaaccgacccacuccucgccgucgacaacggguucuucgccuacucccaccuugagaaaaucggaagcugcacacgcggcauagcaaagcaaagaauaaucggcgucggagaaguacucgaccgcggcgacaaaguccccuccauguucaugaccaacgucuggaccccaccaaaccccuccaccauccaccacugcuccuccaccuaccacgaggacuucuacuacacacucugcgcaguaucacaugugggcgaccccauccucaacuccacauccuggaccgaaagccucucccucauccggcuugccguacguccuaaauccgacagcggaaacuacaaccaaaaguacaucgcaaucacaaaagucgagcggggcaaauacgacaaagucaugccauacggacccuccggcauaaaacaaggagacacccuauacuuccccgccgucggauuccuaccccgcaccgaguuccaauacaacgacuccaacugccccaucauacacuguaaauacucgaaagccgaaaacugccgccucuccaugggagucaacucuaaaucccacuacauccuccgcuccggccuccugaaauacaaccuaagccucgggggcgacaucauccuacaauucaucgaaaucgcggacaaccgacucacaauaggcucacccaguaaaauauacaacagccucggccaaccugucuucuaccaagccucauacuccugggacaccaugauaaaacucggcgacaucgacacagucgacccacugcgcguccaauggcgaaacaacuccguuaucucccguccuggacaaucucaaugcccccgauucaacguaugcccagaagucugcugggaaggaaccuacaacgacgccuuccuuauugaccgacucaacugggucucugcgggcguauaccuuaacuccaaccagaccgccgaaaaccccguauucgcagucuucaaagauaacgaaauccuauaccaagucccccucgccgaagaugacaccaacgcccagaaaacaaucaccgacugcuuccuccucgaaaacguaaucuggugcaucucccucguugaaauauacgacaccggcgacuccguaauacgacccaaacuauucgcugucaaaauccccgcacaaugcucagaauccuaa

SEQ ID NO: 1271 - RNA, 1656 nt, Artificial Sequence
  derived and/or modified CDS sequence (opt11) from Hendra henipavirus__AEQ38052__H1N1-HA(1-17)_G(70-604)
augaaagcgaucuuggucgugcucuuguacacguucgcgaccgcgaacgcgcaaaacuacacacguaccacagacaaccaagcccucauuaaagaauccuuacaauccguccaacaacaaauaaaagcccucaccgacaaaauaggcacugaaaucggccccaaaguaucccucauugacaccagcuccaccaucaccaucccagccaacaucggccuacucgguucgaaaaucucccaaucgacuucauccauaaacgaaaacguaaacgauaagugcaaguucacgcuacccccacuaaaaauacacgaaugcaacauauccugcccaaacccccucccuuuccgcgaauacaggccaaucucccaaggcgucuccgaccuaguaggccuaccuaaccaaauuugccuccaaaagacaaccuccacgauccucaaaccacgccuaauauccuacacccuucccaucaacacccgcgaaggaguaugcaucacagacccacuccucgccgucgacaacggcuucuuugcauauucacaccucgagaaaaucggcucuugcacacgcggcaucgcaaaacaacgcaucaucggcgucggugaaguccuagacagaggcgacaaaguacccuccauguucaugaccaacguauggaccccgccaaaccccucgaccauacaccacuguuccuccaccuaccacgaagacuucuacuacacacucugcgcagucucccacguaggggaccccauccucaacucgacauccuggaccgaaucacuuucccuaauccgccuagcaguacggcccaaaucagacuccggcgacuacaaccaaaaauacauaacaauuaccaaagucgaacguggaaaauacgauaaaguaaugcccuacggccccuccggcauaaaacaaggcgacacacucuacuuccccgcagucggauuccucccccgaaccgaguuccaauacaacgacucaaacugccccaucauacacuguaaauacucaaaagcagaaaacugccgccucuccaugggcguaaacucaaaaucccacuacauucuccgcagcggacuacugaaguacaaccucucacucggcggcgacauuauucuucaauucauagaaaucgccgacaaccgcuuaacaauaggcucacccucaaagaucuacaauucccuuggccaacccgucuucuaccaagcauccuacuccugggacacaaugaucaaguuaggcgaugucgacacagucgacccccuccgugugcaauggcgaaacaauuccgucaucucacgcccaggccaaucccaaugcccccguuucaacgucugccccgaggucugcugggaaggcacauacaacgaugccuuccucaucgaccgucucaacugggucucagccggagucuaccuaaacuccaaccaaacugcagaaaaccccgucuucgccgucuucaaggacaacgaaauccucuaccaaguaccacuagccgaagacgacaccaacgcucagaaaaccaucacagacugcuuucugcuagaaaacgucauauggugcauuucccucgucgaaauauacgauaccggagacuccgucaucagacccaaacuguuugcagucaaaaucccagcacaaugcuccgaauccuaa

SEQ ID NO: 1272 - RNA, 1656 nt, Artificial Sequence
  derived and/or modified CDS sequence (opt11) from Hendra henipavirus__AEQ38115__H1N1-HA(1-17)_G(70-604)
augaaagcgaucuuggucgugcucuuguacacguucgcgaccgcgaacgcgcaaaacuacacccgcacaacugacaaccaagcacucaucaaagaaucacuccaauccguccaacaacaaauaaaagcacucaccgacaaaauagguacagaaaucggccccaaagucucacuaaucgacacaucaagcaccaucacgaucccagccaacaucggccuacucggauccaaaauaucccaaucuacaaguuccaucaacgaaaacguaaacgacaagugcaaauucacccuaccaccccugaaaauacaugaaugcaacaucucaugccccaacccccuccccuuccgagaauaccgccccauuucccaaggaguauccgaccucgugggacuacccaaccaaaucugccugcagaaaacaaccuccacaauccuaaaaccccgacucauuucuuacacgcuccccaucaacacgcgagaaggcguaugcauaaccgacccccuauuagcaguugacaacggcuucuucgccuacucccaccuagagaaaaucggcucauguacccgcggcaucgccaagcaacgcauaaucggcguaggcgaaguccuggaccgaggagacaaggucccaagcauguucaugaccaacguuuggaccccacccaaccccuccaccauccaccacugcagcuccaccuaccacgaagacuucuacuacacgcuuugugccgucucucacgucggagaccccauacuuaacuccacauccuggaccgaaucgcugagccugauccgccucgcgguccgacccaaauccgacaacggcgauuacaaccaaaaauacaucgccaucaccaaaguagaacgaggcaaguacgacaaagucaugcccuacggccccuccggcaucaagcaaggcgacacccuauauuucccagccgucggauuccucccccgcacagaguuccaguacaacgacuccaacugccccaucauucacugcaaguacuccaaagcugaaaacugccggcucucaaugggcgucaacuccaaaucgcacuacauacuacguucuggccuccucaaauacaaccucagccuaggaggagacauaauacuccaauucaucgaaaucgcagacaaccgccucaccaucgggucccccucaaaaauauauaacucccucggccagccugucuucuaccaagccuccuacuccugggacaccaugaucaagcucggagacguugacaccguagacccccuccgcguacaguggcgcaacaacuccgucauaagucgccccggacaaucccaaugccccagauucaacgucugcccagaagucugcugggaaggcacguacaacgacgcauuccuuaucgaucgccuaaauugggucuccgcaggagucuaccucaacucuaaccaaaccgcagaaaaccccgucuucgccgucuucaaagacaacgaaauccucuaccaagucccccucgcugaagacgacaccaacgcacagaaaacuaucaccgauugcuuccuacucgaaaacgucaucuggugcaucucacucguagaaauauacgacaccggcgacuccgucauucgccccaaacucuucgcagucaaaaucccagcccaaugcagcgaaucuuag

SEQ ID NO: 1273 - RNA, 1656 nt, Artificial Sequence
  derived and/or modified CDS sequence (opt11) from Hendra henipavirus__AEQ38108__H1N1-HA(1-17)_G(70-604)
augaaagcgaucuuggucgugcucuuguacacguucgcgaccgcgaacgcgcaaaacuacacacgaacaaccgacaaccaagcccucauuaaggaaucccuccaaucaguccaacaacaaaucaaagcgcuuacugacaagaucggcaccgaaauaggccccaaagucucccuaauugacaccucaucuacaauaaccauccccgccaacaucggccuccuagggucaaaaaucucucaauccacauccagcauaaacgagaacgucaacgacaagugcaaguucacccuaccaccccucaaaauacacgagugcaacauaagcugccccaacccccuccccuuccgagaguaccgccccauaucacagggagucucagaccucguaggacuacccaaccaaaucugccuucagaaaaccacuuccacuauccuuaaaccccgccucaucuccuauacccuaccuaucaacacccgcgaaggcgucugcaucacggacccccuacuagcagucgacaacggcuucuucgcauacucccaucuugagaaaauaggaagcuguacccgaggcauagccaaacaacgcaucaucggcguuggcgaaguccuagaccgcggcgacaaaguccccucuauguucaugaccaacgucuggacucccccaaaccccucaaccauccaccacugcuccucaaccuaccacgaagacuucuacuacacccuaugcgcagucucucacgucggggacccuauacucaacuccacuucauggaccgaaagccucucccuaauccgccuagccgucaggcccaaauccgacucaggcgacuacaaccaaaaauacaucaccaucaccaaggucgaacgaggcaaauacgacaaagucaugcccuacgggcccuccggcauaaaacaaggcaacacccuauauuuuccagccguuggcuuccuuccccgaacugaguuccaauacaaugacuccaacugcccaauaauccacugcaaauacuccaaagcagaaaacugccgacuauccaugggagucaacucgaaaucgcacuacauccuccgcucuggccucuuaaaauacaaccucucccucggcggagacaucauccuccaguucaucgaaaucgccgacaaccgucucaccaucggauccccauccaaaaucuacaauucccucggccaacccgucuuuuaucaggcauccuauuccugggacaccaugaucaaacuuggugacgucgacaccgucgacccccuacgcguacaauggcggaacaacucagucauaucacgcccaggccaaucccagugcccucgcuucaacgucugcccagaaguaugcugggaaggaaccuacaacgacgccuuccucauagaucgccucaacugggucuccgccggcgucuacuuaaacagcaaccaaacagccgaaaacccaguuuucgccgucuucaaagacaacgaaauccuguaccaaguuccacuagccgaagaugacacaaacgcucagaaaaccauuacagacugcuuucuccucgaaaacgugauauggugcauaucccucgucgaaaucuacgacacgggagacuccgucauccguccaaaacuguucgccgucaaaaucccagcccaauguuccgaauccuag

SEQ ID NO: 1274 - RNA, 1656 nt, Artificial Sequence
  derived and/or modified CDS sequence (opt11) from Hendra henipavirus__AAV80426__H1N1-HA(1-17)_G(70-604)
augaaagcgaucuuggucgugcucuuguacacguucgcgaccgcgaacgcgcaaaauuacacccgcaccacagacaaccaagcccucauaaaagaaucccuccaaucaguccaacaacagaucaaagcccugaccgacaaaauaggcacagaaaucggacccaaagucucccuaaucgacaccucauccaccaucacuaucccggcaaacaucggccuccucggcuccaaaaucagccaaugcaccuccucaauaaacgaaaacgucaaugacaaauguaaauuuacccugccgcccuuaaaaauccacgagugcaacaucucaugccccaacccccuccccuuccgcgaauacagacccaucucccaaggcgucucggaccucgucggccuccccaaccaaaucugccuccagaaaaccaccucgaccauucucaagccccgccuaaucuccuacacacucccaauaaauacucgcgagggagucugcaucaccgacccacuacuagccgucgacaacggcuucuuugccuacucccaccuagagaaaaucggcaguugcacccgcggcaucgccaaacaacguauaaucggugucggugaaguacucgacagaggcgacaaaguccccagcauguucaugaccaacgucuggacgcccccaaaccccucaaccauccaccacugcucaucaaccuaccacgaagacuuuuacuacacccucugcgcugucucucacgucggagacccaauccucaacucaacaucauggacagaaagccucagccuaauacgccuagccguccggcccaaauccgacucaggcgacuacaaccaaaaauacauugccauaaccaaagucgaacggggaaaauacgacaaaguuaugcccuauggccccucggggaucaaacaaggagacacccucuacuuccccgcagucggcuuccucccccgcaccgaguuccaauacaacgacuccaacugccccaucauccacugcaaauacagcaaggccgaaaacugccgccuaagcaugggcguaaacuccaagucacacuacauccugcgcucaggacuacugaaauacaaccucucccucggcggagacaucauacuccaauucaucgaaaucgccgacaaccgccuaaccauaggcucccccucaaaaaucuacaacucccuaggccaacccgucuucuaccaagccuccuacucuugggacaccaugauaaaacuaggagacgucgacacugucgacccccuacgcguacaauggcguaacaacucagucaucucccgcccgggccaaagccaaugcccacgcuucaacgucugccccgaaguuugcugggaaggcuccuacaacgacgccuuccuaauagaccgucucaacugggucagcgcaggagucuaccucaacuccaaccaaaccgccgaaaacccugucuuugccguuuucaaggacaacgaaauacucuaccaggucccucucgcagaggacgacaccaacgcacagaaaaccaucaccgacugcuuccugcucgaaaacguaaucuggugcaucucccuugucgaaauauacgacaccggcgacuccgucauacguccaaaacuauucgccguaaaaaucccagcccaaugcuccgaauccuaa

SEQ ID NO: 1275 - RNA, 1858 nt, Artificial Sequence
  mRNA product Design1 comprising derived and/or modified sequence from Nipah henipavirus__AAK50553__F (opt1)
gggagaaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1276 - RNA, 1858 nt, Artificial Sequence
  mRNA product Design1 comprising derived and/or modified sequence from Nipah henipavirus__AEZ01388__F (opt1)
gggagaaagcuuaccauggccgugauccugaacaagcgcuacuacagcaaccuccugauccugauccucaucaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1277 - RNA, 1858 nt, Artificial Sequence
  mRNA product Design1 comprising derived and/or modified sequence from Nipah henipavirus__AAY43915__F (opt1)
gggagaaagcuuaccauggccgugauccugaacaagcgcuacuacagcaaccuccugauccugauccucaugaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1278 - RNA, 1858 nt, Artificial Sequence
  mRNA product Design1 comprising derived and/or modified sequence from Nipah henipavirus__CAF25496__F (opt1)
gggagaaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1279 - RNA, 1858 nt, Artificial Sequence
  mRNA product Design1 comprising derived and/or modified sequence from Nipah henipavirus__AAM13405__F (opt1)
gggagaaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1280 - RNA, 1858 nt, Artificial Sequence
  mRNA product Design1 comprising derived and/or modified sequence from Nipah henipavirus__CBM41033__F (opt1)
gggagaaagcuuaccaugguggucauccuggacaagcgcugcuacagcaaccuccugauccugauccucaugaucuccgagugcagcgugggcauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1281 - RNA, 1858 nt, Artificial Sequence
  mRNA product Design1 comprising derived and/or modified sequence from Nipah henipavirus__AEZ01396__F (opt1)
gggagaaagcuuaccauggccgugauccugaacaagcgcuacuacagcaaccuccugauccugauccucaugaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1282 - RNA, 1858 nt, Artificial Sequence
  mRNA product Design1 comprising derived and/or modified sequence from Hendra henipavirus__NP_047111__F (opt1)
gggagaaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1283 - RNA, 1858 nt, Artificial Sequence
  mRNA product Design1 comprising derived and/or modified sequence from Hendra henipavirus__AEB21233__F (opt1)
gggagaaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1284 - RNA, 1858 nt, Artificial Sequence
  mRNA product Design1 comprising derived and/or modified sequence from Hendra henipavirus__AEQ38114__F (opt1)
gggagaaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1285 - RNA, 1858 nt, Artificial Sequence
  mRNA product Design1 comprising derived and/or modified sequence from Hendra henipavirus__AAB39505__F (opt1)
gggagaaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1286 - RNA, 2026 nt, Artificial Sequence
  mRNA product Design1 comprising derived and/or modified sequence from Nipah henipavirus__AAK50554__G (opt1)
gggagaaagcuuaccaugcccgccgagaacaagaaggugcgcuucgagaacaccaccagcgacaagggcaagaucccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1287 - RNA, 2026 nt, Artificial Sequence
  mRNA product Design1 comprising derived and/or modified sequence from Nipah henipavirus__AEZ01389__G (opt1)
gggagaaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1288 - RNA, 2026 nt, Artificial Sequence
  mRNA product Design1 comprising derived and/or modified sequence from Nipah henipavirus__ACT32615__G (opt1)
gggagaaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1289 - RNA, 2026 nt, Artificial Sequence
  mRNA product Design1 comprising derived and/or modified sequence from Nipah henipavirus__CAF25497__G (opt1)
gggagaaagcuuaccaugcccgccgagaacaagaaggugcgcuucgagaacaccaccagcgacaagggcaagaacccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1290 - RNA, 2026 nt, Artificial Sequence
  mRNA product Design1 comprising derived and/or modified sequence from Nipah henipavirus__CBM41034__G (opt1)
gggagaaagcuuaccaugcccgccgagaacaagaaggugcgcuucgagaacaccaccagcgacaagggcaagaacccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1291 - RNA, 2026 nt, Artificial Sequence
  mRNA product Design1 comprising derived and/or modified sequence from Nipah henipavirus__AAX51853__G (opt1)
gggagaaagcuuaccaugcccgccgagagcaagaaggugcgcuucgagaacaccaccuccgacaagggcaagaucccgagcaagaucaucaaguccuacuacgggacgauggacaucaagaagaucaacgagggccugcucgacagcaagauccuguccgccuucaacaccgucaucgcgcugcucgggagcaucgugaucaucgugaugaacaucaugaucauccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1292 - RNA, 2026 nt, Artificial Sequence
  mRNA product Design1 comprising derived and/or modified sequence from Nipah henipavirus__AEZ01397__G (opt1)
gggagaaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1293 - RNA, 2032 nt, Artificial Sequence
  mRNA product Design1 comprising derived and/or modified sequence from Hendra henipavirus__NP_047112__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1294 - RNA, 2032 nt, Artificial Sequence
  mRNA product Design1 comprising derived and/or modified sequence from Hendra henipavirus__AEB21225__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1295 - RNA, 2032 nt, Artificial Sequence
  mRNA product Design1 comprising derived and/or modified sequence from Hendra henipavirus__AEB21216__G (opt1)
gggagaaagcuuaccaugauggccgacagcaagcuggugucccccaacaacaaccucagcggcaagaucaaggaccaggggaaggucaucaagaacuacuacggcaccauggacaucaagaagaucaacgacgggcugcuggacuccaagauccucggcgccuucaacaccgugaucgcgcugcuggggagcaucaucaucaucgugaugaacaucaugaucauccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1296 - RNA, 2032 nt, Artificial Sequence
  mRNA product Design1 comprising derived and/or modified sequence from Hendra henipavirus__AEB21206__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1297 - RNA, 2032 nt, Artificial Sequence
  mRNA product Design1 comprising derived and/or modified sequence from Hendra henipavirus__AEQ38052__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1298 - RNA, 2032 nt, Artificial Sequence
  mRNA product Design1 comprising derived and/or modified sequence from Hendra henipavirus__AEQ38115__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1299 - RNA, 2032 nt, Artificial Sequence
  mRNA product Design1 comprising derived and/or modified sequence from Hendra henipavirus__AEQ38108__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1300 - RNA, 2032 nt, Artificial Sequence
  mRNA product Design1 comprising derived and/or modified sequence from Hendra henipavirus__AAV80426__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1301 - RNA, 1834 nt, Artificial Sequence
  mRNA product Design1 comprising derived and/or modified sequence from Nipah henipavirus__AAK50553__HsIgE(1-18)_F(27-546) (opt1)
gggagaaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1302 - RNA, 1834 nt, Artificial Sequence
  mRNA product Design1 comprising derived and/or modified sequence from Nipah henipavirus__AEZ01388__HsIgE(1-18)_F(27-546) (opt1)
gggagaaagcuuaccauggacuggaccuggauccuguuccucguggccgccgcgacccgcguccacagcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1303 - RNA, 1834 nt, Artificial Sequence
  mRNA product Design1 comprising derived and/or modified sequence from Nipah henipavirus__AAY43915__HsIgE(1-18)_F(27-546) (opt1)
gggagaaagcuuaccauggacuggaccuggauccuguuccucguggccgccgcgacccgcguccacagcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1304 - RNA, 1834 nt, Artificial Sequence
  mRNA product Design1 comprising derived and/or modified sequence from Nipah henipavirus__CAF25496__HsIgE(1-18)_F(27-546) (opt1)
gggagaaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1305 - RNA, 1834 nt, Artificial Sequence
  mRNA product Design1 comprising derived and/or modified sequence from Nipah henipavirus__AAM13405__HsIgE(1-18)_F(27-546) (opt1)
gggagaaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1306 - RNA, 1834 nt, Artificial Sequence
  mRNA product Design1 comprising derived and/or modified sequence from Nipah henipavirus__CBM41033__HsIgE(1-18)_F(27-546) (opt1)
gggagaaagcuuaccauggacuggaccuggauccuguuccucguggccgccgcgacccgcguccacagcauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1307 - RNA, 1834 nt, Artificial Sequence; identical to SEQ ID NO: 1302
  mRNA product Design1 comprising derived and/or modified sequence from Nipah henipavirus__AEZ01396__HsIgE(1-18)_F(27-546) (opt1)

SEQ ID NO: 1308 - RNA, 1834 nt, Artificial Sequence
  mRNA product Design1 comprising derived and/or modified sequence from Hendra henipavirus__NP_047111__HsIgE(1-18)_F(27-546) (opt1)
gggagaaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1309 - RNA, 1834 nt, Artificial Sequence
  mRNA product Design1 comprising derived and/or modified sequence from Hendra henipavirus__AEB21233__HsIgE(1-18)_F(27-546) (opt1)
gggagaaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1310 - RNA, 1837 nt, Artificial Sequence
  mRNA product Design1 comprising derived and/or modified sequence from Hendra henipavirus__AEQ38114__HsIgE(1-18)_F(26-546) (opt1)
gggagaaagcuuaccauggacuggaccuggauccuguuccucguggccgccgcgacccgcguccacagcggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1311 - RNA, 1834 nt, Artificial Sequence
  mRNA product Design1 comprising derived and/or modified sequence from Hendra henipavirus__AAB39505__HsIgE(1-18)_F(27-546) (opt1)
gggagaaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1312 - RNA, 1870 nt, Artificial Sequence
  mRNA product Design1 comprising derived and/or modified sequence from Nipah henipavirus__AAK50554__HsIgE(1-18)_G(70-602) (opt1)
gggagaaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1313 - RNA, 1870 nt, Artificial Sequence
  mRNA product Design1 comprising derived and/or modified sequence from Nipah henipavirus__AEZ01389__HsIgE(1-18)_G(70-602) (opt1)
gggagaaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1314 - RNA, 1870 nt, Artificial Sequence
  mRNA product Design1 comprising derived and/or modified sequence from Nipah henipavirus__ACT32615__HsIgE(1-18)_G(70-602) (opt1)
gggagaaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1315 - RNA, 1870 nt, Artificial Sequence
  mRNA product Design1 comprising derived and/or modified sequence from Nipah henipavirus__CAF25497__HsIgE(1-18)_G(70-602) (opt1)
gggagaaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1316 - RNA, 1870 nt, Artificial Sequence
  mRNA product Design1 comprising derived and/or modified sequence from Nipah henipavirus__CBM41034__HsIgE(1-18)_G(70-602) (opt1)
gggagaaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1317 - RNA, 1870 nt, Artificial Sequence
  mRNA product Design1 comprising derived and/or modified sequence from Nipah henipavirus__AAX51853__HsIgE(1-18)_G(70-602) (opt1)
gggagaaagcuuaccauggacuggaccuggauccuguuccucguggccgccgcgacccgcguccacagccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1318 - RNA, 1870 nt, Artificial Sequence
  mRNA product Design1 comprising derived and/or modified sequence from Nipah henipavirus__AEZ01397__HsIgE(1-18)_G(70-602) (opt1)
gggagaaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1319 - RNA, 1876 nt, Artificial Sequence
  mRNA product Design1 comprising derived and/or modified sequence from Hendra henipavirus__NP_047112__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1320 - RNA, 1876 nt, Artificial Sequence
  mRNA product Design1 comprising derived and/or modified sequence from Hendra henipavirus__AEB21225__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1321 - RNA, 1876 nt, Artificial Sequence
  mRNA product Design1 comprising derived and/or modified sequence from Hendra henipavirus__AEB21216__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1322 - RNA, 1876 nt, Artificial Sequence
  mRNA product Design1 comprising derived and/or modified sequence from Hendra henipavirus__AEB21206__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1323 - RNA, 1876 nt, Artificial Sequence
  mRNA product Design1 comprising derived and/or modified sequence from Hendra henipavirus__AEQ38052__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1324 - RNA, 1876 nt, Artificial Sequence
  mRNA product Design1 comprising derived and/or modified sequence from Hendra henipavirus__AEQ38115__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1325 - RNA, 1876 nt, Artificial Sequence
  mRNA product Design1 comprising derived and/or modified sequence from Hendra henipavirus__AEQ38108__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1326 - RNA, 1876 nt, Artificial Sequence
  mRNA product Design1 comprising derived and/or modified sequence from Hendra henipavirus__AAV80426__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1327 - RNA, 1831 nt, Artificial Sequence
  mRNA product Design1 comprising derived and/or modified sequence from Nipah henipavirus__AAK50553__H1N1-HA(1-17)_F(27-546) (opt1)
gggagaaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1328 - RNA, 1831 nt, Artificial Sequence
  mRNA product Design1 comprising derived and/or modified sequence from Nipah henipavirus__AEZ01388__H1N1-HA(1-17)_F(27-546) (opt1)
gggagaaagcuuaccaugaaggccauccuggugguccuccuguacaccuucgccaccgcgaacgccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1329 - RNA, 1831 nt, Artificial Sequence
  mRNA product Design1 comprising derived and/or modified sequence from Nipah henipavirus__AAY43915__H1N1-HA(1-17)_F(27-546) (opt1)
gggagaaagcuuaccaugaaggccauccuggugguccuccuguacaccuucgccaccgcgaacgccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1330 - RNA, 1831 nt, Artificial Sequence
  mRNA product Design1 comprising derived and/or modified sequence from Nipah henipavirus__CAF25496__H1N1-HA(1-17)_F(27-546) (opt1)
gggagaaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1331 - RNA, 1831 nt, Artificial Sequence
  mRNA product Design1 comprising derived and/or modified sequence from Nipah henipavirus__AAM13405__H1N1-HA(1-17)_F(27-546) (opt1)
gggagaaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1332 - RNA, 1831 nt, Artificial Sequence
  mRNA product Design1 comprising derived and/or modified sequence from Nipah henipavirus__CBM41033__H1N1-HA(1-17)_F(27-546) (opt1)
gggagaaagcuuaccaugaaggccauccuggugguccuccuguacaccuucgccaccgcgaacgccauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1333 - RNA, 1831 nt, Artificial Sequence; identical to SEQ ID NO: 1328
  mRNA product Design1 comprising derived and/or modified sequence from Nipah henipavirus__AEZ01396__H1N1-HA(1-17)_F(27-546) (opt1)

SEQ ID NO: 1334 - RNA, 1831 nt, Artificial Sequence
  mRNA product Design1 comprising derived and/or modified sequence from Hendra henipavirus__NP_047111__H1N1-HA(1-17)_F(27-546) (opt1)
gggagaaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1335 - RNA, 1831 nt, Artificial Sequence
  mRNA product Design1 comprising derived and/or modified sequence from Hendra henipavirus__AEB21233__H1N1-HA(1-17)_F(27-546) (opt1)
gggagaaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1336 - RNA, 1834 nt, Artificial Sequence
  mRNA product Design1 comprising derived and/or modified sequence from Hendra henipavirus__AEQ38114__H1N1-HA(1-17)_F(26-546) (opt1)
gggagaaagcuuaccaugaaggccauccuggugguccuccuguacaccuucgccaccgcgaacgccggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1337 - RNA, 1831 nt, Artificial Sequence
  mRNA product Design1 comprising derived and/or modified sequence from Hendra henipavirus__AAB39505__H1N1-HA(1-17)_F(27-546) (opt1)
gggagaaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1338 - RNA, 1867 nt, Artificial Sequence
  mRNA product Design1 comprising derived and/or modified sequence from Nipah henipavirus__AAK50554__H1N1-HA(1-17)_G(70-602) (opt1)
gggagaaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1339 - RNA, 1867 nt, Artificial Sequence
  mRNA product Design1 comprising derived and/or modified sequence from Nipah henipavirus__AEZ01389__H1N1-HA(1-17)_G(70-602) (opt1)
gggagaaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1340 - RNA, 1867 nt, Artificial Sequence
  mRNA product Design1 comprising derived and/or modified sequence from Nipah henipavirus__ACT32615__H1N1-HA(1-17)_G(70-602) (opt1)
gggagaaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1341 - RNA, 1867 nt, Artificial Sequence
  mRNA product Design1 comprising derived and/or modified sequence from Nipah henipavirus__CAF25497__H1N1-HA(1-17)_G(70-602) (opt1)
gggagaaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1342 - RNA, 1867 nt, Artificial Sequence
  mRNA product Design1 comprising derived and/or modified sequence from Nipah henipavirus__CBM41034__H1N1-HA(1-17)_G(70-602) (opt1)
gggagaaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1343 - RNA, 1867 nt, Artificial Sequence
  mRNA product Design1 comprising derived and/or modified sequence from Nipah henipavirus__AAX51853__H1N1-HA(1-17)_G(70-602) (opt1)
gggagaaagcuuaccaugaaggccauccuggugguccuccuguacaccuucgccaccgcgaacgcccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1344 - RNA, 1867 nt, Artificial Sequence
  mRNA product Design1 comprising derived and/or modified sequence from Nipah henipavirus__AEZ01397__H1N1-HA(1-17)_G(70-602) (opt1)
gggagaaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1345 - RNA, 1873 nt, Artificial Sequence
  mRNA product Design1 comprising derived and/or modified sequence from Hendra henipavirus__NP_047112__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1346 - RNA, 1873 nt, Artificial Sequence
  mRNA product Design1 comprising derived and/or modified sequence from Hendra henipavirus__AEB21225__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1347 - RNA, 1873 nt, Artificial Sequence
  mRNA product Design1 comprising derived and/or modified sequence from Hendra henipavirus__AEB21216__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1348 - RNA, 1873 nt, Artificial Sequence
  mRNA product Design1 comprising derived and/or modified sequence from Hendra henipavirus__AEB21206__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1349 - RNA, 1873 nt, Artificial Sequence
  mRNA product Design1 comprising derived and/or modified sequence from Hendra henipavirus__AEQ38052__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1350 - RNA, 1873 nt, Artificial Sequence
  mRNA product Design1 comprising derived and/or modified sequence from Hendra henipavirus__AEQ38115__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1351 - RNA, 1873 nt, Artificial Sequence
  mRNA product Design1 comprising derived and/or modified sequence from Hendra henipavirus__AEQ38108__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1352 - RNA, 1873 nt, Artificial Sequence
  mRNA product Design1 comprising derived and/or modified sequence from Hendra henipavirus__AAV80426__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1353 - RNA, 2023 nt, Artificial Sequence
  mRNA product Design2 comprising derived and/or modified sequence from Nipah henipavirus__AAK50553__F (opt1) R6000/R6311
ggggcgcugccuacggagguggcagccaucuccuucucggcaucaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1354 - RNA, 2023 nt, Artificial Sequence
  mRNA product Design2 comprising derived and/or modified sequence from Nipah henipavirus__AEZ01388__F (opt1)
ggggcgcugccuacggagguggcagccaucuccuucucggcaucaagcuuaccauggccgugauccugaacaagcgcuacuacagcaaccuccugauccugauccucaucaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1355 - RNA, 2023 nt, Artificial Sequence
  mRNA product Design2 comprising derived and/or modified sequence from Nipah henipavirus__AAY43915__F (opt1) R6005/R6312
ggggcgcugccuacggagguggcagccaucuccuucucggcaucaagcuuaccauggccgugauccugaacaagcgcuacuacagcaaccuccugauccugauccucaugaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1356 - RNA, 2023 nt, Artificial Sequence
  mRNA product Design2 comprising derived and/or modified sequence from Nipah henipavirus__CAF25496__F (opt1)
ggggcgcugccuacggagguggcagccaucuccuucucggcaucaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1357 - RNA, 2023 nt, Artificial Sequence
  mRNA product Design2 comprising derived and/or modified sequence from Nipah henipavirus__AAM13405__F (opt1)
ggggcgcugccuacggagguggcagccaucuccuucucggcaucaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1358 - RNA, 2023 nt, Artificial Sequence
  mRNA product Design2 comprising derived and/or modified sequence from Nipah henipavirus__CBM41033__F (opt1)
ggggcgcugccuacggagguggcagccaucuccuucucggcaucaagcuuaccaugguggucauccuggacaagcgcugcuacagcaaccuccugauccugauccucaugaucuccgagugcagcgugggcauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1359 - RNA, 2023 nt, Artificial Sequence
  mRNA product Design2 comprising derived and/or modified sequence from Nipah henipavirus__AEZ01396__F (opt1)
ggggcgcugccuacggagguggcagccaucuccuucucggcaucaagcuuaccauggccgugauccugaacaagcgcuacuacagcaaccuccugauccugauccucaugaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1360 - RNA, 2023 nt, Artificial Sequence
  mRNA product Design2 comprising derived and/or modified sequence from Hendra henipavirus__NP_047111__F (opt1) R6009/R6649
ggggcgcugccuacggagguggcagccaucuccuucucggcaucaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1361 - RNA, 2023 nt, Artificial Sequence
  mRNA product Design2 comprising derived and/or modified sequence from Hendra henipavirus__AEB21233__F (opt1)
ggggcgcugccuacggagguggcagccaucuccuucucggcaucaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1362 - RNA, 2023 nt, Artificial Sequence
  mRNA product Design2 comprising derived and/or modified sequence from Hendra henipavirus__AEQ38114__F (opt1)
ggggcgcugccuacggagguggcagccaucuccuucucggcaucaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1363 - RNA, 2023 nt, Artificial Sequence
  mRNA product Design2 comprising derived and/or modified sequence from Hendra henipavirus__AAB39505__F (opt1)
ggggcgcugccuacggagguggcagccaucuccuucucggcaucaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1364 - RNA, 2191 nt, Artificial Sequence
  mRNA product Design2 comprising derived and/or modified sequence from Nipah henipavirus__AAK50554__G (opt1) R6003/R6647
ggggcgcugccuacggagguggcagccaucuccuucucggcaucaagcuuaccaugcccgccgagaacaagaaggugcgcuucgagaacaccaccagcgacaagggcaagaucccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1365 - RNA, 2191 nt, Artificial Sequence
  mRNA product Design2 comprising derived and/or modified sequence from Nipah henipavirus__AEZ01389__G (opt1) R6007/R6648
ggggcgcugccuacggagguggcagccaucuccuucucggcaucaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1366 - RNA, 2191 nt, Artificial Sequence
  mRNA product Design2 comprising derived and/or modified sequence from Nipah henipavirus__ACT32615__G (opt1)
ggggcgcugccuacggagguggcagccaucuccuucucggcaucaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1367 - RNA, 2191 nt, Artificial Sequence
  mRNA product Design2 comprising derived and/or modified sequence from Nipah henipavirus__CAF25497__G (opt1)
ggggcgcugccuacggagguggcagccaucuccuucucggcaucaagcuuaccaugcccgccgagaacaagaaggugcgcuucgagaacaccaccagcgacaagggcaagaacccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1368 - RNA, 2191 nt, Artificial Sequence
  mRNA product Design2 comprising derived and/or modified sequence from Nipah henipavirus__CBM41034__G (opt1)
ggggcgcugccuacggagguggcagccaucuccuucucggcaucaagcuuaccaugcccgccgagaacaagaaggugcgcuucgagaacaccaccagcgacaagggcaagaacccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1369 - RNA, 2191 nt, Artificial Sequence
  mRNA product Design2 comprising derived and/or modified sequence from Nipah henipavirus__AAX51853__G (opt1)
ggggcgcugccuacggagguggcagccaucuccuucucggcaucaagcuuaccaugcccgccgagagcaagaaggugcgcuucgagaacaccaccuccgacaagggcaagaucccgagcaagaucaucaaguccuacuacgggacgauggacaucaagaagaucaacgagggccugcucgacagcaagauccuguccgccuucaacaccgucaucgcgcugcucgggagcaucgugaucaucgugaugaacaucaugaucauccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1370 - RNA, 2191 nt, Artificial Sequence
  mRNA product Design2 comprising derived and/or modified sequence from Nipah henipavirus__AEZ01397__G (opt1)
ggggcgcugccuacggagguggcagccaucuccuucucggcaucaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1371 - RNA, 2197 nt, Artificial Sequence
  mRNA product Design2 comprising derived and/or modified sequence from Hendra henipavirus__NP_047112__G (opt1) R6011/R6650
ggggcgcugccuacggagguggcagccaucuccuucucggcaucaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1372 - RNA, 2197 nt, Artificial Sequence
  mRNA product Design2 comprising derived and/or modified sequence from Hendra henipavirus__AEB21225__G (opt1)
ggggcgcugccuacggagguggcagccaucuccuucucggcaucaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1373 - RNA, 2197 nt, Artificial Sequence
  mRNA product Design2 comprising derived and/or modified sequence from Hendra henipavirus__AEB21216__G (opt1)
ggggcgcugccuacggagguggcagccaucuccuucucggcaucaagcuuaccaugauggccgacagcaagcuggugucccccaacaacaaccucagcggcaagaucaaggaccaggggaaggucaucaagaacuacuacggcaccauggacaucaagaagaucaacgacgggcugcuggacuccaagauccucggcgccuucaacaccgugaucgcgcugcuggggagcaucaucaucaucgugaugaacaucaugaucauccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1374 - RNA, 2197 nt, Artificial Sequence
  mRNA product Design2 comprising derived and/or modified sequence from Hendra henipavirus__AEB21206__G (opt1)
ggggcgcugccuacggagguggcagccaucuccuucucggcaucaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1375 - RNA, 2197 nt, Artificial Sequence
  mRNA product Design2 comprising derived and/or modified sequence from Hendra henipavirus__AEQ38052__G (opt1)
ggggcgcugccuacggagguggcagccaucuccuucucggcaucaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1376 - RNA, 2197 nt, Artificial Sequence
  mRNA product Design2 comprising derived and/or modified sequence from Hendra henipavirus__AEQ38115__G (opt1)
ggggcgcugccuacggagguggcagccaucuccuucucggcaucaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1377 - RNA, 2197 nt, Artificial Sequence
  mRNA product Design2 comprising derived and/or modified sequence from Hendra henipavirus__AEQ38108__G (opt1)
ggggcgcugccuacggagguggcagccaucuccuucucggcaucaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1378 - RNA, 2197 nt, Artificial Sequence
  mRNA product Design2 comprising derived and/or modified sequence from Hendra henipavirus__AAV80426__G (opt1)
ggggcgcugccuacggagguggcagccaucuccuucucggcaucaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1379 - RNA, 1999 nt, Artificial Sequence
  mRNA product Design2 comprising derived and/or modified sequence from Nipah henipavirus__AAK50553__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1380 - RNA, 1999 nt, Artificial Sequence
  mRNA product Design2 comprising derived and/or modified sequence from Nipah henipavirus__AEZ01388__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1381 - RNA, 1999 nt, Artificial Sequence
  mRNA product Design2 comprising derived and/or modified sequence from Nipah henipavirus__AAY43915__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1382 - RNA, 1999 nt, Artificial Sequence
  mRNA product Design2 comprising derived and/or modified sequence from Nipah henipavirus__CAF25496__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1383 - RNA, 1999 nt, Artificial Sequence
  mRNA product Design2 comprising derived and/or modified sequence from Nipah henipavirus__AAM13405__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1384 - RNA, 1999 nt, Artificial Sequence
  mRNA product Design2 comprising derived and/or modified sequence from Nipah henipavirus__CBM41033__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1385 - RNA, 1999 nt, Artificial Sequence; identical to SEQ ID NO: 1380
  mRNA product Design2 comprising derived and/or modified sequence from Nipah henipavirus__AEZ01396__HsIgE(1-18)_F(27-546) (opt1)

SEQ ID NO: 1386 - RNA, 1999 nt, Artificial Sequence
  mRNA product Design2 comprising derived and/or modified sequence from Hendra henipavirus__NP_047111__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1387 - RNA, 1999 nt, Artificial Sequence
  mRNA product Design2 comprising derived and/or modified sequence from Hendra henipavirus__AEB21233__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1388 - RNA, 2002 nt, Artificial Sequence
  mRNA product Design2 comprising derived and/or modified sequence from Hendra henipavirus__AEQ38114__HsIgE(1-18)_F(26-546) (opt1)
ggggcgcugccuacggagguggcagccaucuccuucucggcaucaagcuuaccauggacuggaccuggauccuguuccucguggccgccgcgacccgcguccacagcggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1389 - RNA, 1999 nt, Artificial Sequence
  mRNA product Design2 comprising derived and/or modified sequence from Hendra henipavirus__AAB39505__HsIgE(1-18)_F(27-546) (opt1)
ggggcgcugccuacggagguggcagccaucuccuucucggcaucaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1390 - RNA, 2035 nt, Artificial Sequence
  mRNA product Design2 comprising derived and/or modified sequence from Nipah henipavirus__AAK50554__HsIgE(1-18)_G(70-602) (opt1)
ggggcgcugccuacggagguggcagccaucuccuucucggcaucaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1391 - RNA, 2035 nt, Artificial Sequence
  mRNA product Design2 comprising derived and/or modified sequence from Nipah henipavirus__AEZ01389__HsIgE(1-18)_G(70-602) (opt1)
ggggcgcugccuacggagguggcagccaucuccuucucggcaucaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1392 - RNA, 2035 nt, Artificial Sequence
  mRNA product Design2 comprising derived and/or modified sequence from Nipah henipavirus__ACT32615__HsIgE(1-18)_G(70-602) (opt1)
ggggcgcugccuacggagguggcagccaucuccuucucggcaucaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1393 - RNA, 2035 nt, Artificial Sequence
  mRNA product Design2 comprising derived and/or modified sequence from Nipah henipavirus__CAF25497__HsIgE(1-18)_G(70-602) (opt1)
ggggcgcugccuacggagguggcagccaucuccuucucggcaucaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1394 - RNA, 2035 nt, Artificial Sequence
  mRNA product Design2 comprising derived and/or modified sequence from Nipah henipavirus__CBM41034__HsIgE(1-18)_G(70-602) (opt1)
ggggcgcugccuacggagguggcagccaucuccuucucggcaucaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1395 - RNA, 2035 nt, Artificial Sequence
  mRNA product Design2 comprising derived and/or modified sequence from Nipah henipavirus__AAX51853__HsIgE(1-18)_G(70-602) (opt1)
ggggcgcugccuacggagguggcagccaucuccuucucggcaucaagcuuaccauggacuggaccuggauccuguuccucguggccgccgcgacccgcguccacagccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1396 - RNA, 2035 nt, Artificial Sequence
  mRNA product Design2 comprising derived and/or modified sequence from Nipah henipavirus__AEZ01397__HsIgE(1-18)_G(70-602) (opt1)
ggggcgcugccuacggagguggcagccaucuccuucucggcaucaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1397 - RNA, 2041 nt, Artificial Sequence
  mRNA product Design2 comprising derived and/or modified sequence from Hendra henipavirus__NP_047112__HsIgE(1-18)_G(70-604) (opt1) R6016/R6651
ggggcgcugccuacggagguggcagccaucuccuucucggcaucaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1398 - RNA, 2041 nt, Artificial Sequence
  mRNA product Design2 comprising derived and/or modified sequence from Hendra henipavirus__AEB21225__HsIgE(1-18)_G(70-604) (opt1)
ggggcgcugccuacggagguggcagccaucuccuucucggcaucaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1399 - RNA, 2041 nt, Artificial Sequence
  mRNA product Design2 comprising derived and/or modified sequence from Hendra henipavirus__AEB21216__HsIgE(1-18)_G(70-604) (opt1)
ggggcgcugccuacggagguggcagccaucuccuucucggcaucaagcuuaccauggacuggaccuggauccuguuccucguggccgccgcgacccgcguccacagccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1400 - RNA, 2041 nt, Artificial Sequence
  mRNA product Design2 comprising derived and/or modified sequence from Hendra henipavirus__AEB21206__HsIgE(1-18)_G(70-604) (opt1)
ggggcgcugccuacggagguggcagccaucuccuucucggcaucaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1401 - RNA, 2041 nt, Artificial Sequence
  mRNA product Design2 comprising derived and/or modified sequence from Hendra henipavirus__AEQ38052__HsIgE(1-18)_G(70-604) (opt1)
ggggcgcugccuacggagguggcagccaucuccuucucggcaucaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1402 - RNA, 2041 nt, Artificial Sequence
  mRNA product Design2 comprising derived and/or modified sequence from Hendra henipavirus__AEQ38115__HsIgE(1-18)_G(70-604) (opt1)
ggggcgcugccuacggagguggcagccaucuccuucucggcaucaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1403 - RNA, 2041 nt, Artificial Sequence
  mRNA product Design2 comprising derived and/or modified sequence from Hendra henipavirus__AEQ38108__HsIgE(1-18)_G(70-604) (opt1)
ggggcgcugccuacggagguggcagccaucuccuucucggcaucaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1404 - RNA, 2041 nt, Artificial Sequence
  mRNA product Design2 comprising derived and/or modified sequence from Hendra henipavirus__AAV80426__HsIgE(1-18)_G(70-604) (opt1)
ggggcgcugccuacggagguggcagccaucuccuucucggcaucaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1405 - RNA, 1996 nt, Artificial Sequence
  mRNA product Design2 comprising derived and/or modified sequence from Nipah henipavirus__AAK50553__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1406 - RNA, 1996 nt, Artificial Sequence
  mRNA product Design2 comprising derived and/or modified sequence from Nipah henipavirus__AEZ01388__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1407 - RNA, 1996 nt, Artificial Sequence
  mRNA product Design2 comprising derived and/or modified sequence from Nipah henipavirus__AAY43915__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1408 - RNA, 1996 nt, Artificial Sequence
  mRNA product Design2 comprising derived and/or modified sequence from Nipah henipavirus__CAF25496__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1409 - RNA, 1996 nt, Artificial Sequence
  mRNA product Design2 comprising derived and/or modified sequence from Nipah henipavirus__AAM13405__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1410 - RNA, 1996 nt, Artificial Sequence
  mRNA product Design2 comprising derived and/or modified sequence from Nipah henipavirus__CBM41033__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1411 - RNA, 1996 nt, Artificial Sequence; identical to SEQ ID NO: 1406
  mRNA product Design2 comprising derived and/or modified sequence from Nipah henipavirus__AEZ01396__H1N1-HA(1-17)_F(27-546) (opt1)

SEQ ID NO: 1412 - RNA, 1996 nt, Artificial Sequence
  mRNA product Design2 comprising derived and/or modified sequence from Hendra henipavirus__NP_047111__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1413 - RNA, 1996 nt, Artificial Sequence
  mRNA product Design2 comprising derived and/or modified sequence from Hendra henipavirus__AEB21233__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1414 - RNA, 1999 nt, Artificial Sequence
  mRNA product Design2 comprising derived and/or modified sequence from Hendra henipavirus__AEQ38114__H1N1-HA(1-17)_F(26-546) (opt1)
ggggcgcugccuacggagguggcagccaucuccuucucggcaucaagcuuaccaugaaggccauccuggugguccuccuguacaccuucgccaccgcgaacgccggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1415 - RNA, 1996 nt, Artificial Sequence
  mRNA product Design2 comprising derived and/or modified sequence from Hendra henipavirus__AAB39505__H1N1-HA(1-17)_F(27-546) (opt1)
ggggcgcugccuacggagguggcagccaucuccuucucggcaucaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1416 - RNA, 2032 nt, Artificial Sequence
  mRNA product Design2 comprising derived and/or modified sequence from Nipah henipavirus__AAK50554__H1N1-HA(1-17)_G(70-602) (opt1)
ggggcgcugccuacggagguggcagccaucuccuucucggcaucaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1417 - RNA, 2032 nt, Artificial Sequence
  mRNA product Design2 comprising derived and/or modified sequence from Nipah henipavirus__AEZ01389__H1N1-HA(1-17)_G(70-602) (opt1)
ggggcgcugccuacggagguggcagccaucuccuucucggcaucaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1418 - RNA, 2032 nt, Artificial Sequence
  mRNA product Design2 comprising derived and/or modified sequence from Nipah henipavirus__ACT32615__H1N1-HA(1-17)_G(70-602) (opt1)
ggggcgcugccuacggagguggcagccaucuccuucucggcaucaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1419 - RNA, 2032 nt, Artificial Sequence
  mRNA product Design2 comprising derived and/or modified sequence from Nipah henipavirus__CAF25497__H1N1-HA(1-17)_G(70-602) (opt1)
ggggcgcugccuacggagguggcagccaucuccuucucggcaucaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1420 - RNA, 2032 nt, Artificial Sequence
  mRNA product Design2 comprising derived and/or modified sequence from Nipah henipavirus__CBM41034__H1N1-HA(1-17)_G(70-602) (opt1)
ggggcgcugccuacggagguggcagccaucuccuucucggcaucaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1421 - RNA, 2032 nt, Artificial Sequence
  mRNA product Design2 comprising derived and/or modified sequence from Nipah henipavirus__AAX51853__H1N1-HA(1-17)_G(70-602) (opt1)
ggggcgcugccuacggagguggcagccaucuccuucucggcaucaagcuuaccaugaaggccauccuggugguccuccuguacaccuucgccaccgcgaacgcccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1422 - RNA, 2032 nt, Artificial Sequence
  mRNA product Design2 comprising derived and/or modified sequence from Nipah henipavirus__AEZ01397__H1N1-HA(1-17)_G(70-602) (opt1)
ggggcgcugccuacggagguggcagccaucuccuucucggcaucaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1423 - RNA, 2038 nt, Artificial Sequence
  mRNA product Design2 comprising derived and/or modified sequence from Hendra henipavirus__NP_047112__H1N1-HA(1-17)_G(70-604) (opt1)
ggggcgcugccuacggagguggcagccaucuccuucucggcaucaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1424 - RNA, 2038 nt, Artificial Sequence
  mRNA product Design2 comprising derived and/or modified sequence from Hendra henipavirus__AEB21225__H1N1-HA(1-17)_G(70-604) (opt1)
ggggcgcugccuacggagguggcagccaucuccuucucggcaucaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1425 - RNA, 2038 nt, Artificial Sequence
  mRNA product Design2 comprising derived and/or modified sequence from Hendra henipavirus__AEB21216__H1N1-HA(1-17)_G(70-604) (opt1)
ggggcgcugccuacggagguggcagccaucuccuucucggcaucaagcuuaccaugaaggccauccuggugguccuccuguacaccuucgccaccgcgaacgcccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1426 - RNA, 2038 nt, Artificial Sequence
  mRNA product Design2 comprising derived and/or modified sequence from Hendra henipavirus__AEB21206__H1N1-HA(1-17)_G(70-604) (opt1)
ggggcgcugccuacggagguggcagccaucuccuucucggcaucaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1427 - RNA, 2038 nt, Artificial Sequence
  mRNA product Design2 comprising derived and/or modified sequence from Hendra henipavirus__AEQ38052__H1N1-HA(1-17)_G(70-604) (opt1)
ggggcgcugccuacggagguggcagccaucuccuucucggcaucaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1428 - RNA, 2038 nt, Artificial Sequence
  mRNA product Design2 comprising derived and/or modified sequence from Hendra henipavirus__AEQ38115__H1N1-HA(1-17)_G(70-604) (opt1)
ggggcgcugccuacggagguggcagccaucuccuucucggcaucaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1429 - RNA, 2038 nt, Artificial Sequence
  mRNA product Design2 comprising derived and/or modified sequence from Hendra henipavirus__AEQ38108__H1N1-HA(1-17)_G(70-604) (opt1)
ggggcgcugccuacggagguggcagccaucuccuucucggcaucaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1430 - RNA, 2038 nt, Artificial Sequence
  mRNA product Design2 comprising derived and/or modified sequence from Hendra henipavirus__AAV80426__H1N1-HA(1-17)_G(70-604) (opt1)
ggggcgcugccuacggagguggcagccaucuccuucucggcaucaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1431 - RNA, 1823 nt, Artificial Sequence
  mRNA product Design3 comprising derived and/or modified sequence from Nipah henipavirus__AAK50553__F (opt1)
gggagaaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1432 - RNA, 1823 nt, Artificial Sequence
  mRNA product Design3 comprising derived and/or modified sequence from Nipah henipavirus__AEZ01388__F (opt1)
gggagaaagcuuaccauggccgugauccugaacaagcgcuacuacagcaaccuccugauccugauccucaucaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1433 - RNA, 1823 nt, Artificial Sequence
  mRNA product Design3 comprising derived and/or modified sequence from Nipah henipavirus__AAY43915__F (opt1)
gggagaaagcuuaccauggccgugauccugaacaagcgcuacuacagcaaccuccugauccugauccucaugaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1434 - RNA, 1823 nt, Artificial Sequence
  mRNA product Design3 comprising derived and/or modified sequence from Nipah henipavirus__CAF25496__F (opt1)
gggagaaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1435 - RNA, 1823 nt, Artificial Sequence
  mRNA product Design3 comprising derived and/or modified sequence from Nipah henipavirus__AAM13405__F (opt1)
gggagaaagcuuaccaugguggucauccuggacaagcgcugcuacugcaaccuccugauccugauccucaugaucagcgagugcuccgugggcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1436 - RNA, 1823 nt, Artificial Sequence
  mRNA product Design3 comprising derived and/or modified sequence from Nipah henipavirus__CBM41033__F (opt1)
gggagaaagcuuaccaugguggucauccuggacaagcgcugcuacagcaaccuccugauccugauccucaugaucuccgagugcagcgugggcauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1437 - RNA, 1823 nt, Artificial Sequence
  mRNA product Design3 comprising derived and/or modified sequence from Nipah henipavirus__AEZ01396__F (opt1)
gggagaaagcuuaccauggccgugauccugaacaagcgcuacuacagcaaccuccugauccugauccucaugaucuccgagugcagcgucggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1438 - RNA, 1823 nt, Artificial Sequence
  mRNA product Design3 comprising derived and/or modified sequence from Hendra henipavirus__NP_047111__F (opt1)
gggagaaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1439 - RNA, 1823 nt, Artificial Sequence
  mRNA product Design3 comprising derived and/or modified sequence from Hendra henipavirus__AEB21233__F (opt1)
gggagaaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1440 - RNA, 1823 nt, Artificial Sequence
  mRNA product Design3 comprising derived and/or modified sequence from Hendra henipavirus__AEQ38114__F (opt1)
gggagaaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1441 - RNA, 1823 nt, Artificial Sequence
  mRNA product Design3 comprising derived and/or modified sequence from Hendra henipavirus__AAB39505__F (opt1)
gggagaaagcuuaccauggccacccaggaggugcgccugaagugccuccugugcggcaucaucguccuggugcucagccuggaggggcugggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1442 - RNA, 1991 nt, Artificial Sequence
  mRNA product Design3 comprising derived and/or modified sequence from Nipah henipavirus__AAK50554__G (opt1)
gggagaaagcuuaccaugcccgccgagaacaagaaggugcgcuucgagaacaccaccagcgacaagggcaagaucccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1443 - RNA, 1991 nt, Artificial Sequence
  mRNA product Design3 comprising derived and/or modified sequence from Nipah henipavirus__AEZ01389__G (opt1)
gggagaaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1444 - RNA, 1991 nt, Artificial Sequence
  mRNA product Design3 comprising derived and/or modified sequence from Nipah henipavirus__ACT32615__G (opt1)
gggagaaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1445 - RNA, 1991 nt, Artificial Sequence
  mRNA product Design3 comprising derived and/or modified sequence from Nipah henipavirus__CAF25497__G (opt1)
gggagaaagcuuaccaugcccgccgagaacaagaaggugcgcuucgagaacaccaccagcgacaagggcaagaacccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1446 - RNA, 1991 nt, Artificial Sequence
  mRNA product Design3 comprising derived and/or modified sequence from Nipah henipavirus__CBM41034__G (opt1)
gggagaaagcuuaccaugcccgccgagaacaagaaggugcgcuucgagaacaccaccagcgacaagggcaagaacccguccaaggucaucaagagcuacuacgggacgauggacaucaagaagaucaacgagggccugcucgacuccaagauccugagcgccuucaacaccgugaucgcgcugcucggguccaucgugaucaucgucaugaacaucaugaucauccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1447 - RNA, 1991 nt, Artificial Sequence
  mRNA product Design3 comprising derived and/or modified sequence from Nipah henipavirus__AAX51853__G (opt1)
gggagaaagcuuaccaugcccgccgagagcaagaaggugcgcuucgagaacaccaccuccgacaagggcaagaucccgagcaagaucaucaaguccuacuacgggacgauggacaucaagaagaucaacgagggccugcucgacagcaagauccuguccgccuucaacaccgucaucgcgcugcucgggagcaucgugaucaucgugaugaacaucaugaucauccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1448 - RNA, 1991 nt, Artificial Sequence
  mRNA product Design3 comprising derived and/or modified sequence from Nipah henipavirus__AEZ01397__G (opt1)
gggagaaagcuuaccaugcccaccgagagcaagaaggugcgcuucgagaacaccgccuccgacaagggcaagaacccgagcaaggucaucaaguccuacuacgggacgauggacaucaagaagaucaacgagggccuccucgacagcaagauccuguccgccuucaacaccgugaucgcgcugcucgggagcaucgugaucaucgucaugaacaucaugaucauccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1449 - RNA, 1997 nt, Artificial Sequence
  mRNA product Design3 comprising derived and/or modified sequence from Hendra henipavirus__NP_047112__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1450 - RNA, 1997 nt, Artificial Sequence
  mRNA product Design3 comprising derived and/or modified sequence from Hendra henipavirus__AEB21225__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1451 - RNA, 1997 nt, Artificial Sequence
  mRNA product Design3 comprising derived and/or modified sequence from Hendra henipavirus__AEB21216__G (opt1)
gggagaaagcuuaccaugauggccgacagcaagcuggugucccccaacaacaaccucagcggcaagaucaaggaccaggggaaggucaucaagaacuacuacggcaccauggacaucaagaagaucaacgacgggcugcuggacuccaagauccucggcgccuucaacaccgugaucgcgcugcuggggagcaucaucaucaucgugaugaacaucaugaucauccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1452 - RNA, 1997 nt, Artificial Sequence
  mRNA product Design3 comprising derived and/or modified sequence from Hendra henipavirus__AEB21206__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1453 - RNA, 1997 nt, Artificial Sequence
  mRNA product Design3 comprising derived and/or modified sequence from Hendra henipavirus__AEQ38052__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1454 - RNA, 1997 nt, Artificial Sequence
  mRNA product Design3 comprising derived and/or modified sequence from Hendra henipavirus__AEQ38115__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1455 - RNA, 1997 nt, Artificial Sequence
  mRNA product Design3 comprising derived and/or modified sequence from Hendra henipavirus__AEQ38108__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1456 - RNA, 1997 nt, Artificial Sequence
  mRNA product Design3 comprising derived and/or modified sequence from Hendra henipavirus__AAV80426__G (opt1)
gggagaaagcuuaccaugauggccgacagcaagcucgugucccucaacaacaaccugagcggcaagaucaaggaccaggggaaggucaucaagaacuacuacggcaccauggacaucaagaagaucaacgacgggcugcucgacuccaagauccugggcgccuucaacaccgugaucgcgcugcucgggagcaucaucaucaucgugaugaacaucaugaucauccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1457 - RNA, 1799 nt, Artificial Sequence
  mRNA product Design3 comprising derived and/or modified sequence from Nipah henipavirus__AAK50553__HsIgE(1-18)_F(27-546) (opt1)
gggagaaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1458 - RNA, 1799 nt, Artificial Sequence
  mRNA product Design3 comprising derived and/or modified sequence from Nipah henipavirus__AEZ01388__HsIgE(1-18)_F(27-546) (opt1)
gggagaaagcuuaccauggacuggaccuggauccuguuccucguggccgccgcgacccgcguccacagcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1459 - RNA, 1799 nt, Artificial Sequence
  mRNA product Design3 comprising derived and/or modified sequence from Nipah henipavirus__AAY43915__HsIgE(1-18)_F(27-546) (opt1)
gggagaaagcuuaccauggacuggaccuggauccuguuccucguggccgccgcgacccgcguccacagcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1460 - RNA, 1799 nt, Artificial Sequence
  mRNA product Design3 comprising derived and/or modified sequence from Nipah henipavirus__CAF25496__HsIgE(1-18)_F(27-546) (opt1)
gggagaaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1461 - RNA, 1799 nt, Artificial Sequence
  mRNA product Design3 comprising derived and/or modified sequence from Nipah henipavirus__AAM13405__HsIgE(1-18)_F(27-546) (opt1)
gggagaaagcuuaccauggacuggaccuggauccuguuccucguggccgccgcgacccgcguccacagcauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1462 - RNA, 1799 nt, Artificial Sequence
  mRNA product Design3 comprising derived and/or modified sequence from Nipah henipavirus__CBM41033__HsIgE(1-18)_F(27-546) (opt1)
gggagaaagcuuaccauggacuggaccuggauccuguuccucguggccgccgcgacccgcguccacagcauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1463 - RNA, 1799 nt, Artificial Sequence; identical to SEQ ID NO: 1458
  mRNA product Design3 comprising derived and/or modified sequence from Nipah henipavirus__AEZ01396__HsIgE(1-18)_F(27-546) (opt1)

SEQ ID NO: 1464 - RNA, 1799 nt, Artificial Sequence
  mRNA product Design3 comprising derived and/or modified sequence from Hendra henipavirus__NP_047111__HsIgE(1-18)_F(27-546) (opt1)
gggagaaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1465 - RNA, 1799 nt, Artificial Sequence
  mRNA product Design3 comprising derived and/or modified sequence from Hendra henipavirus__AEB21233__HsIgE(1-18)_F(27-546) (opt1)
gggagaaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1466 - RNA, 1802 nt, Artificial Sequence
  mRNA product Design3 comprising derived and/or modified sequence from Hendra henipavirus__AEQ38114__HsIgE(1-18)_F(26-546) (opt1)
gggagaaagcuuaccauggacuggaccuggauccuguuccucguggccgccgcgacccgcguccacagcggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1467 - RNA, 1799 nt, Artificial Sequence
  mRNA product Design3 comprising derived and/or modified sequence from Hendra henipavirus__AAB39505__HsIgE(1-18)_F(27-546) (opt1)
gggagaaagcuuaccauggacuggaccuggauccuguuccucguggccgccgcgacccgcguccacagcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1468 - RNA, 1835 nt, Artificial Sequence
  mRNA product Design3 comprising derived and/or modified sequence from Nipah henipavirus__AAK50554__HsIgE(1-18)_G(70-602) (opt1)
gggagaaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1469 - RNA, 1835 nt, Artificial Sequence
  mRNA product Design3 comprising derived and/or modified sequence from Nipah henipavirus__AEZ01389__HsIgE(1-18)_G(70-602) (opt1)
gggagaaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1470 - RNA, 1835 nt, Artificial Sequence
  mRNA product Design3 comprising derived and/or modified sequence from Nipah henipavirus__ACT32615__HsIgE(1-18)_G(70-602) (opt1)
gggagaaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1471 - RNA, 1835 nt, Artificial Sequence
  mRNA product Design3 comprising derived and/or modified sequence from Nipah henipavirus__CAF25497__HsIgE(1-18)_G(70-602) (opt1)
gggagaaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1472 - RNA, 1835 nt, Artificial Sequence
  mRNA product Design3 comprising derived and/or modified sequence from Nipah henipavirus__CBM41034__HsIgE(1-18)_G(70-602) (opt1)
gggagaaagcuuaccauggacuggaccuggauccuguuccucguggccgccgcgacccgcguccacagccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1473 - RNA, 1835 nt, Artificial Sequence
  mRNA product Design3 comprising derived and/or modified sequence from Nipah henipavirus__AAX51853__HsIgE(1-18)_G(70-602) (opt1)
gggagaaagcuuaccauggacuggaccuggauccuguuccucguggccgccgcgacccgcguccacagccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1474 - RNA, 1835 nt, Artificial Sequence
  mRNA product Design3 comprising derived and/or modified sequence from Nipah henipavirus__AEZ01397__HsIgE(1-18)_G(70-602) (opt1)
gggagaaagcuuaccauggacuggaccuggauccuguuccucguggccgccgcgacccgcguccacagccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1475 - RNA, 1841 nt, Artificial Sequence
  mRNA product Design3 comprising derived and/or modified sequence from Hendra henipavirus__NP_047112__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1476 - RNA, 1841 nt, Artificial Sequence
  mRNA product Design3 comprising derived and/or modified sequence from Hendra henipavirus__AEB21225__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1477 - RNA, 1841 nt, Artificial Sequence
  mRNA product Design3 comprising derived and/or modified sequence from Hendra henipavirus__AEB21216__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1478 - RNA, 1841 nt, Artificial Sequence
  mRNA product Design3 comprising derived and/or modified sequence from Hendra henipavirus__AEB21206__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1479 - RNA, 1841 nt, Artificial Sequence
  mRNA product Design3 comprising derived and/or modified sequence from Hendra henipavirus__AEQ38052__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1480 - RNA, 1841 nt, Artificial Sequence
  mRNA product Design3 comprising derived and/or modified sequence from Hendra henipavirus__AEQ38115__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1481 - RNA, 1841 nt, Artificial Sequence
  mRNA product Design3 comprising derived and/or modified sequence from Hendra henipavirus__AEQ38108__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1482 - RNA, 1841 nt, Artificial Sequence
  mRNA product Design3 comprising derived and/or modified sequence from Hendra henipavirus__AAV80426__HsIgE(1-18)_G(70-604) (opt1)
gggagaaagcuuaccauggacuggaccuggauccuguuccucguggccgccgcgacccgcguccacagccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1483 - RNA, 1796 nt, Artificial Sequence
  mRNA product Design3 comprising derived and/or modified sequence from Nipah henipavirus__AAK50553__H1N1-HA(1-17)_F(27-546) (opt1)
gggagaaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaugaccaacaacaugcgcgagugccucaccggguccacggagaagugcccccgggagcuggucgugagcucccacgugccccgcuucgcccugagcaacggcguccucuucgcgaacugcaucuccgugaccugccagugccagaccaccggccgggccaucagccaguccggggagcagacgcugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccacguccagcggggaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1484 - RNA, 1796 nt, Artificial Sequence
  mRNA product Design3 comprising derived and/or modified sequence from Nipah henipavirus__AEZ01388__H1N1-HA(1-17)_F(27-546) (opt1)
gggagaaagcuuaccaugaaggccauccuggugguccuccuguacaccuucgccaccgcgaacgccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguaccugagcgaccuccuguucgucuucggccccaaccugcaggacccgguguccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcggcuacuacaucaucguccggguguacuuccccauccucaccgagauccagcaggccuacauccaggagcugcugcccgugagcuucaacaacgacaacuccgaguggaucagcaucguccccaacuucauccucgugcgcaacacccugaucuccaacaucgagaucggguucugccugaucacgaagcggagcgugaucugcaaccaggacuacgccaccccgaugaccaacaacaugcgcgagugccucaccggcuccacggagaagugcccccgggagcuggucgugagcucccacgucccccgcuucgcgcugagcaacggcgugcuguucgccaacugcaucuccgugaccugccagugccagaccaccgggcgggccaucagccaguccggcgagcagacgcugcugaugaucgacaacacgaccugccccaccgccguccucgggaacgugaucaucagccugggcaaguaccugggguccgugaacuacaacagcgagggcaucgccaucggcccgcccgucuucaccgacaagguggacaucuccagccagaucuccagcaugaaccagucccuccagcagagcaaggacuacaucaaggaggcgcagcgccugcuggacaccgugaaccccagccugaucuccaugcucagcaugaucauccuguacguccuguccaucgccagccucugcaucgggcugaucaccuucaucuccuucaucaucguggagaagaagcggaacaccuacagccgccuggaggaccggcgcgugcggcccacguccagcggcgaccucuacuacaucgggaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1485 - RNA, 1796 nt, Artificial Sequence
  mRNA product Design3 comprising derived and/or modified sequence from Nipah henipavirus__AAY43915__H1N1-HA(1-17)_F(27-546) (opt1)
gggagaaagcuuaccaugaaggccauccuggugguccuccuguacaccuucgccaccgcgaacgccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1486 - RNA, 1796 nt, Artificial Sequence
  mRNA product Design3 comprising derived and/or modified sequence from Nipah henipavirus__CAF25496__H1N1-HA(1-17)_F(27-546) (opt1)
gggagaaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccaucgaggacuucgacgaccuccuggaguccgacagcaucacggggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucaccaagcggagcgugaucugcaaccaggacuacgccacgccgaugaccaacaacaugcgcgagugccucaccggguccaccgagaagugcccccgggagcuggucgugagcucccacgugccccgcuucgcccugagcaacggcguccucuucgcgaacugcaucuccgugacgugccagugccagaccaccggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacacggugaaccccagccugaucuccaugcucagcaugaucauccuguacgugcuguccaucgcgagccucugcaucggccugaucaccuucaucuccuucaucaucgucgagaagaagcggaacaccuacagccgccuggaggaccggcgcgugcggcccaccuccagcggggaccucuacuacaucggcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1487 - RNA, 1796 nt, Artificial Sequence
  mRNA product Design3 comprising derived and/or modified sequence from Nipah henipavirus__AAM13405__H1N1-HA(1-17)_F(27-546) (opt1)
gggagaaagcuuaccaugaaggccauccuggugguccuccuguacaccuucgccaccgcgaacgccauccugcacuacgagaagcugagcaagaucgggcucgugaagggcgucacccggaaguacaagaucaaguccaacccccugaccaaggacaucgugaucaagaugaucccgaacgugagcaacaugucccagugcacggggagcgucauggagaacuacaagacccgccugaacggcauccucacccccaucaagggggcccuggagaucuacaagaacaacacccacgaccuggugggcgacgugcggcucgccggcgucaucauggcggggguggccaucggcaucgccacggccgcccagaucaccgcggggguggcccuguacgaggccaugaagaacgccgacaacaucaacaagcugaaguccagcaucgaguccaccaacgaggcggucgugaagcuccaggagaccgccgagaagacgguguacguccugaccgcccugcaggacuacaucaacaccaaccucgugcccaccaucgacaagaucagcugcaagcagacggagcugucccuggaccucgcccugagcaaguaccuguccgaccuccuguucguguucggccccaaccugcaggacccggucagcaacuccaugaccauccaggccaucagccaggcguucgggggcaacuacgagacccuccugcgcacccugggcuacgccacggaggacuucgacgaccuccuggaguccgacagcaucaccgggcagaucaucuacguggaccuguccagcuacuacaucaucgugcgggucuacuuccccauccucaccgagauccagcaggccuacauccaggagcugcugcccgugagcuucaacaacgacaacuccgaguggaucagcaucgugcccaacuucauccucguccgcaacacccugaucuccaacaucgagaucggcuucugccugaucacgaagcggagcgugaucugcaaccaggacuacgccaccccgaccaccaacaacaugcgcgagugccucacgggguccaccgagaagugcccccgggagcuggucgugagcucccacgugccccgcuucgcccugagcaacggcguccucuucgcgaacugcaucuccgugaccugccagugccagaccacgggccgggccaucagccaguccggggagcagacccugcugaugaucgacaacacgaccugccccaccgccgugcucggcaacgucaucaucagccuggggaaguaccugggcuccgugaacuacaacagcgaggggaucgccaucggcccgcccguguucaccgacaaggucgacaucuccagccagaucuccagcaugaaccagucccuccagcagagcaaggacuacaucaaggaggcccagcgccugcuggacaccgugaaccccagccugaucuccaugcucagcaugaucauccuguacgugcuguccaucgcgagccucugcaucggccugaucaccuucaucuccuucaucaucgucgagaagaagcggaacacguacagccgccuggaggaccggcgcgugcggcccaccuccagcggggaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1488 - RNA, 1796 nt, Artificial Sequence
  mRNA product Design3 comprising derived and/or modified sequence from Nipah henipavirus__CBM41033__H1N1-HA(1-17)_F(27-546) (opt1)
gggagaaagcuuaccaugaaggccauccuggugguccuccuguacaccuucgccaccgcgaacgccauccugcacuacgagaagcuguccaagaucgggcucgugaagggcgucacccggaaguacaagaucaagagcaacccccugaccaaggacaucgugaucaagaugaucgccaacguguccaacaugagccagugcacgggguccgucauggagaacuacaagacccgccugaacggcauccucaccccgaucaagggggcccuggagaucuacaagaacaacacccacgaccuggugggcgacgugcggcucgcgggcgucaucauggccgggguggccaucggcaucgccacggccgcgcagaucaccgccgggguggcccuguacgaggccaugaagaacgcggacaacaucaacaagcucaagagcuccaucgagagcaccaacgaggccgucgugaagcugcaggagaccgccgagaagacgguguacguccugaccgcccugcaggacuacaucaacaccaaccucgugcccaccaucgacaagaucuccugcaagcagacggagcugagccuggaccucgcccuguccaaguaccugagcgaccuccuguucguguucggccccaaccugcaggaccccgucuccaacagcaugaccauccaggcgaucucccaggccuucgggggcaacuacgagacccuccugcgcacccugggcuacgccacggaggacuucgacgaccuccuggagagcgacuccaucaccgggcagaucaucuacguggaccugagcagcuacuacaucaucgugcgggucuacuucccgauccucaccgagauccagcaggccuacauccaggagcugcugcccguguccuucaacaacgacaacagcgaguggaucuccaucgugcccaacuucauccucguccgcaacacccugaucagcaacaucgagaucggcuucugccugaucacgaagcgguccgugaucugcaaccaggacuacgccacccccaugaccaacaacaugcgcgagugccucaccgggagcacggagaagugcccgcgggagcuggucguguccagccacgugccccgcuucgcgcuguccaacggcguccucuucgccaacugcaucagcgugaccugccagugccagaccaccggccgggccaucucccagagcggggagcagacgcugcugaugaucgacaacacgaccugccccaccgccgugcucggcaacgucaucaucucccuggggaaguaccugggcagcgugaacuacaacuccgaggggaucgccaucgggcccccgguguucaccgacaaggucgacaucagcucccagaaguccagcaugaaccagagccuccagcagagcaaggacuacaucaaggaggcgcagcgccugcuggacaccgugaaccccucccugaucagcaugcucuccaugaucauccuguacgugcugagcaucgccucccucugcaucggccugaucaccuucaucagcuucaucaucgucgagaagaagcggaacaccuacucccgccuggaggaccggcgcgugcggcccacgagcuccggcgaccucuacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1489 - RNA, 1796 nt, Artificial Sequence; identical to SEQ ID NO: 1484
  mRNA product Design3 comprising derived and/or modified sequence from Nipah henipavirus__AEZ01396__H1N1-HA(1-17)_F(27-546) (opt1)

SEQ ID NO: 1490 - RNA, 1796 nt, Artificial Sequence
  mRNA product Design3 comprising derived and/or modified sequence from Hendra henipavirus__NP_047111__H1N1-HA(1-17)_F(27-546) (opt1)
gggagaaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucgccgggcagaucguguacguggaccugagcuccuacuacaucaucguccgcguguacuuccccauccugaccgagauccagcaggcguacgugcaggagcuccugcccgucagcuucaacaacgacaacagcgaguggaucuccaucgugcccaacuucguccugauccggaacacccucaucagcaacaucgaggugaaguacugccugaucacgaagaaguccgugaucugcaaccaggacuacgccaccccgaugaccgccagcguccgcgagugccugaccggcuccacggacaagugcccccgggagcucguggugagcucccacgucccccgcuucgcccugagcggcggggugcuguucgccaacugcaucuccgugaccugccagugccagaccaccggccgggcgaucagccaguccggggagcagacgcuccugaugaucgacaacacgaccugcaccaccgucgugcugggcaacaucaucaucagccucgggaaguaccugggcuccaucaacuacaacagcgaguccaucgccguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucaccuucaucuccuucgugaucguggagaagaagcgcggcaacuacagccggcucgacgaccgccagguccggcccguguccaacggggaccuguacuacaucggcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1491 - RNA, 1796 nt, Artificial Sequence
  mRNA product Design3 comprising derived and/or modified sequence from Hendra henipavirus__AEB21233__H1N1-HA(1-17)_F(27-546) (opt1)
gggagaaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucgugaucguggagaagaagcgcggcaacuacagccggcucgacgaccgccagguccggcccguguccaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1492 - RNA, 1799 nt, Artificial Sequence
  mRNA product Design3 comprising derived and/or modified sequence from Hendra henipavirus__AEQ38114__H1N1-HA(1-17)_F(26-546) (opt1)
gggagaaagcuuaccaugaaggccauccuggugguccuccuguacaccuucgccaccgcgaacgccggcauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugagcgaccuccuguucguguucggccccaaccugcaggacccggucuccaacagcaugaccauccaggccaucucccaggccuucggcgggaacuacgagacccugcuccggacgcugggcuacgccaccgaggacuucgacgaccugcucgagagcgacuccaucaccgggcagaucguguacguggaccugagcuccuacuacaucaucguccgcguguacuuccccauccugaccgagauccagcaggccuacgugcaggagcuccugcccgucagcuucaacaacgacaacagcgaguggaucuccaucgugcccaacuucguccugauccggaacacgcucaucagcaacaucgaggugaaguacugccugaucaccaagaaguccgugaucugcaaccaggacuacgcgaccccgaugaccgccagcguccgcgagugccugacgggcuccaccgacaagugcccccgggagcucguggugagcucccacgucccccgcuucgcccugagcggcggggugcuguucgccaacugcaucuccgugaccugccagugccagaccacgggccgggccaucagccaguccggggagcagacccuccugaugaucgacaacacgaccugcaccaccgucgugcugggcaacaucaucaucagccucgggaaguaccugggcuccaucaacuacaacagcgaguccaucgcgguggggcccccggucuacaccgacaagguggacaucagcucccagaucagcuccaugaaccagagccugcagcagagcaaggacuacaucaaggaggcccagaagauccuggacaccgugaaccccucccucaucagcaugcuguccaugaucauccuguacguccucagcaucgccgcccugugcaucggccugaucacguucaucuccuucaucaucguggagaagaagcgcggcaacuacagccggcucgacgaccgccaggugcggcccgucuccaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1493 - RNA, 1796 nt, Artificial Sequence
  mRNA product Design3 comprising derived and/or modified sequence from Hendra henipavirus__AAB39505__H1N1-HA(1-17)_F(27-546) (opt1)
gggagaaagcuuaccaugaaggccauccuggugguccuccuguacaccuucgccaccgcgaacgccauccuccacuacgagaagcuguccaagaucgggcuggugaagggcaucacccggaaguacaagaucaagagcaacccccucacgaaggacaucgucaucaagaugaucccgaacguguccaacgugagcaagugcaccgggaccgucauggagaacuacaagucccgccugaccggcauccugagccccaucaagggcgccaucgagcucuacaacaacaacacgcacgaccuggugggggacgugaagcuggcgggcgucgugauggccgggaucgccaucggcaucgccaccgccgcgcagaucaccgccgggguggcccucuacgaggccaugaagaacgcggacaacaucaacaagcugaaguccagcaucgaguccaccaacgaggccgucgugaagcugcaggagacggccgagaagaccguguacguccucaccgcccugcaggacuacaucaacaccaaccuggugcccacgaucgaccagaucagcugcaagcagaccgagcucgcccuggaccuggcgcucuccaaguaccugcugaucugcagcugcuucggccccaaccuccaggacccgguguccaacagcaugaccauccaggccaucucccaggccuucggcgggaacuacgagacccugcugcggacgcucggcuacgccaccgaggacuucgacgaccugcuggagagcgacuccaucaccgggcagaucgucuacguggaccucagcuccuacuacaucaucgugcgcgucuacuuccccauccugaccgagauccagcaggccuacgugcaggagcugcuccccgugagcuucaacaacgacaacagcgaguggaucuccaucguccccaacuucgugcugauccggaacacgcugaucagcaacaucgaggucaaguacugccucaucaccaagaaguccgugaucugcaaccaggacuacgcgaccccgaugaccgccagcgugcgcgagugccugacgggcuccaccgacaagugcccccgggagcuggucgugagcucccacgugccccgcuucgcccucagcggcgggguccuguucgccaacugcaucuccgugaccugccagugccagaccacgggccgggccaucagccagucccgcgagcagacccugcucaugaucgacaacacgaccugcaccaccgugguccuggggaacaucaucaucagccugcccaaguaccucggcuccaucaagcuccaggugcugcgggcgcugcugcuggggcaccagagcauccagaccaagguggacaucuccagccagaucuccagcaugaaccagucccugcagcagagcaaggacuacaucaaggaggcccagaagauccucgacaccgucaacccgagccugaucuccaugcugagcaugaucauccucuacgugcuguccaucgccgcccugugcaucggccucaucacguucaucagcuucgugaucgucgagaagaagcgcggcaacuacucccggcuggacgaccgccaggugcggcccgugagcaacggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1494 - RNA, 1832 nt, Artificial Sequence
  mRNA product Design3 comprising derived and/or modified sequence from Nipah henipavirus__AAK50554__H1N1-HA(1-17)_G(70-602) (opt1)
gggagaaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggccuccuucagcugggacacgaugaucaaguucggcgacgugcugaccgucaacccgcucguggugaacuggcgcaacaacaccgucaucucccggcccgggcagagccagugcccccgcuucaacacgugcccggagaucugcugggagggcguguacaacgacgcguuccugaucgaccggaucaacuggaucuccgccgggguguuccuggacagcaaccagaccgccgagaaccccgucuucaccguguucaaggacaacgagauccucuaccgcgcccagcuggccuccgaggacaccaacgcgcagaagaccaucacgaacugcuuccugcucaagaacaagaucuggugcaucagccugguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1495 - RNA, 1832 nt, Artificial Sequence
  mRNA product Design3 comprising derived and/or modified sequence from Nipah henipavirus__AEZ01389__H1N1-HA(1-17)_G(70-602) (opt1)
gggagaaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagaccgugaacccccuggucgugaacuggcgggacaacacggugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacaccaacgcccagaagacgaucaccaacugcuuccuccugaagaacaagaucuggugcaucucccuggucgagaucuacgacaccggcgacaacgugauccgcccgaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1496 - RNA, 1832 nt, Artificial Sequence
  mRNA product Design3 comprising derived and/or modified sequence from Nipah henipavirus__ACT32615__H1N1-HA(1-17)_G(70-602) (opt1)
gggagaaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgguccucaacagcaccuacugguccgggagccugaugaugacccgccuggccgugaagcccaagaacaacggcgaguccuacaaccagcaccaguucgcccuccggaacaucgagaaggggaaguacgacaaggugaugcccuacggccccagcgggaucaagcagggcgacacgcuguacuucccggccgucggcuuccuggugcgcaccgaguucaaguacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucgucuucaucgagaucagcgaccagcgccugagcaucggguccccgagcaagaucuacgacucccucggccagcccguguucuaccaggcgagcuucuccugggacaccaugaucaaguucggggacgugcagaccgucaacccccugguggugaacuggcgggacaacacggucaucagccgccccggccagucccagugcccgcgguucaacaagugccccgaggugugcugggagggcguguacaacgacgccuuccugaucgaccgcaucaacuggaucagcgccggggucuuccucgacuccaaccagaccgccgagaaccccguguucaccguguucaaggacaacgagguccuguaccgggcccagcuggcgagcgaggacaccaacgcccagaagacgaucaccaacugcuuccuccugaagaacaagaucuggugcaucucccugguggagaucuacgacaccggcgacaacgugauccgcccgaagcuguucgccgucaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1497 - RNA, 1832 nt, Artificial Sequence
  mRNA product Design3 comprising derived and/or modified sequence from Nipah henipavirus__CAF25497__H1N1-HA(1-17)_G(70-602) (opt1)
gggagaaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccaacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucugggccccgcccaaccccaacacgguguaccacugcuccgcgguguacaacaacgaguucuacuacguccugugcgccgugagcaccgugggggaccccauccucaacuccaccuacuggagcggcucccugaugaugacccgccuggccgucaagcccaagagcaacgggggcggguacaaccagcaccagcucgcccugcgguccaucgagaagggccgcuacgacaaggugaugcccuacggcccgagcgggaucaagcagggcgacacgcuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagguggucuucaucgagaucuccgaccagcggcucagcaucggcucccccagcaagaucuacgacagccuggggcagcccguguucuaccaggcguccuucagcugggacaccaugaucaaguucggcgacgugcugacggucaacccgcucguggugaacuggcgcaacaacaccgucaucucccggcccgggcagagccagugcccccgcuucaacacgugcccggagaucugcugggagggcguguacaacgacgccuuccugaucgaccggaucaacuggaucuccgccgggguguuccuggacagcaaccagaccgccgagaaccccgucuucaccguguucaaggacaacgagauccucuaccgcgcccagcuggcguccgaggacaccaacgcccagaagaccaucaccaacugcuuccugcucaagaacaagaucuggugcaucagccugguggagaucuacgacacgggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1498 - RNA, 1832 nt, Artificial Sequence
  mRNA product Design3 comprising derived and/or modified sequence from Nipah henipavirus__CBM41034__H1N1-HA(1-17)_G(70-602) (opt1)
gggagaaagcuuaccaugaaggccauccuggugguccuccuguacaccuucgccaccgcgaacgcccagaacuacacccggagcaccgacaaccaggccgugaucaaggacgcccugcagggcauccagcagcagaucaaggggcuggccgacaagaucggcacggagaucggccccaaggugucccucaucgacaccagcuccaccaucaccauccccgccaacaucgggcugcugggcagcaagaucucccagagcacggcguccaucaacgagaacgucaacgagaagugcaaguucacccugcccccgcucaagauccacgagugcaacaucagcugccccaacccccugcccuuccgcgaguaccggccgcagaccgaggggguguccaaccucgugggccugcccgacaacaucugccugcagaagaccagcaaccagauccucaagcccaagcugaucuccuacacgcugcccgucguggggcagagcgggaccugcaucaccgacccgcuccuggccauggacgagggcuacuucgccuacucccaccuggagcgcaucggcagcugcagccggggcguguccaagcagcgcaucaucggggucggcgaggugcucgaccggggcgacgaggugcccagccuguucaugaccaacgucuggacgccgcccaaccccaacaccguguaccacugcuccgccguguacaacaacgaguucuacuacguccugugcgcggugagcaccgugggggaccccauccucaacuccaccuacuggagcggcucccugaugaugacgcgccuggccgucaagcccaagagcaacgggggcggguacaaccagcaccagcucgcccugcgguccaucgagaagggccgcuacgacaaggugaugcccuacggcccgagcgggaucaagcagggcgacacccuguacuuccccgccgugggguuccucguccggaccgaguucaaguacaacgacuccaacugccccaucaccaagugccaguacagcaagcccgagaacugccgccuguccaugggcauccggccgaacagccacuacauccugcgcuccgggcuccugaaguacaaccugagcgacggcgagaaccccaagaucguguucaucgagaucuccgaccagcggcucagcaucggcucccccagcaaggucuacgacagccuggggcagcccguguucuaccaggccuccuucagcugggacacgaugaucaaguucggcgacgugcagaccgucaacccgcugguggugaacuggcgcgacaacaccgucaucucccggcccgggcagagccagugcccccgcuucaacacgugcccggagaucugcugggagggcguguacaacgacgcguuccucaucgaccggaucaacuggaucuccgccgggguguuccuggacagcaaccagaccgccgagaaccccgucuucaccguguucaaggacaacgagauccuguaccgcgcccagcucgccuccgaggacaccaacgcgcagaagaccaucacgaacugcuuccugcugaagaacaagaucuggugcaucagccucguggagaucuacgacaccggcgacaacgucauccggcccaagcuguucgccgugaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1499 - RNA, 1832 nt, Artificial Sequence
  mRNA product Design3 comprising derived and/or modified sequence from Nipah henipavirus__AAX51853__H1N1-HA(1-17)_G(70-602) (opt1)
gggagaaagcuuaccaugaaggccauccuggugguccuccuguacaccuucgccaccgcgaacgcccagaacuacacccgguccaccgacaaccaggccgucaucaaggacgcccugcagggcauccagcagcagaucaaggggcuggccgacaagaucggcacggagaucggccccaaggugagccucaucgacaccuccagcaccaucaccauccccgccaacaucgggcugcugggcuccaagaucagccaguccacggcgagcaucaacgagaacgugaacgagaagugcaaguucacccugcccccgcucaagauccacgagugcaacaucuccugccccaacccccugcccuuccgcgaguaccggccgcagaccgagggggucagcaaccucgugggccugcccaacaacaucugccugcagaagaccuccaaccagauccucaagcccaagcugaucagcuacacgcugcccguggucgggcaguccgggaccugcaucaccgacccgcuccuggccauggacgagggcuacuucgccuacagccaccuggagcgcaucggcagcugcucccggggcgugagcaagcagaagaucaucggggugggcgagguccucgaccgcggcgacgaggugcccucccuguucaugaccaacguguggacgccgcccaaccccaacaccgucuaccacugcagcgccguguacaacaacgaguucuacuacgugcugugcgcggucuccaccgugggggaccccauccucaacagcaccuacugguccggcagccugaugaugacgcggcuggccgugaagcccaaguccaacgacgggggcuacaaccagcaccagcucgcccugcgcagcaucgagaaggggcgguacgacaaggucaugcccuacggcccguccggcaucaagcagggggacacccuguacuuccccgccgugggcuuccucgugcgcaccgaguucaaguacaacgacagcaacugccccaucaccaagugccaguacuccaagcccgagaacugccggcugagcauggggauccgcccgaacucccacuacguccugcggagcggccuccugaaguacaaccuguccgacggggagaaccccaagaucguguucaucgagaucagcgaccagcgccucuccaucggcagccccagcaagaucuacgacucccugggccagcccgucuucuaccaggccagcuucuccugggacacgaugaucaaguucggggacgugcagaccgugaacccgcuggucgugagcuggcgggacaacaccgugaucucccgccccggccagagccagugcccccgguucaacacgugcccggagaucugcugggagggggucuacaacgacgcguuccucaucgaccgcaucaacuggaucuccgccggcguguuccuggacagcaaccagaccgccgagaaccccguguucaccgucuucaaggacaacgagauccuguaccgggcccagcucgccuccgaggacaccaacgcgcagaagaccaucacgaacugcuuccugcugaagaacaagaucuggugcaucagccucguggagaucuacgacaccggggacaacgugauccgccccaagcuguucgccgucaagauccccgagcagugcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1500 - RNA, 1832 nt, Artificial Sequence
  mRNA product Design3 comprising derived and/or modified sequence from Nipah henipavirus__AEZ01397__H1N1-HA(1-17)_G(70-602) (opt1)
gggagaaagcuuaccaugaaggccauccuggugguccuccuguacaccuucgccaccgcgaacgcccagaacuacacccgguccaccgacaaccaggccaugaucaaggacgcccugcagagcauccagcagcagaucaagggccuggccgacaagaucgggacggagaucggccccaaggugucccucaucgacaccagcuccaccaucaccauccccgccaacaucggccugcuggggagcaagaucucccagagcacggcguccaucaacgagaacgugaacgagaagugcaaguucacccugcccccgcucaagauccacgagugcaacaucagcugccccaacccccugcccuuccgcgaguacaagccgcagaccgagggcgucuccaaccucguggggcugcccaacaacaucugccugcagaagaccagcaaccagauccucaagcccaagcugaucuccuacacgcugcccguggucggccagagcgggaccugcaucaccgacccgcuccuggccauggacgagggcuacuucgccuacagccaccuggagaagaucggcuccugcagccgcgggguguccaagcagcggaucaucggcgugggggagguccucgaccggggcgacgaggugcccagccuguucaugaccaacguguggacgcccuccaaccccaacaccgucuaccacugcagcgccguguacaacaacgaguucuacuacgugcugugcgcggucuccguggugggcgacccgauccucaacagcaccuacugguccgggagccugaugaugacccgccuggccgucaagcccaagaacaacggcgaguccuacaaccagcaccaguucgcccuccggaacaucgagaaggggaaguacgacaaggugaugcccuacggccccagcgggaucaagcagggcgacacgcuguacuucccggccgugggcuuccugguccgcaccgaguucaccuacaacgacuccaacugccccaucgccgagugccaguacagcaagcccgagaacugccggcucuccauggggauccgccccaacagccacuacauccugcgguccggccugcucaaguacaaccugagcgacgaggagaacuccaagaucguguucaucgagaucagcgaccagcgccugagcaucggguccccgagcaagaucuacgacucccucggccagcccgucuucuaccaggcgagcuucuccugggacaccaugaucaaguucggggacgugcagacggugaacccccuggucgugaacuggcgggacaacaccgugaucagccgccccggccagucccagugcccgcgguucaacaagugccccgaggucugcugggagggcguguacaacgacgccuuccugaucgaccgcaucaacuggaucagcgccgggguguuccucgacuccaaccagaccgccgagaaccccgucuucaccguguucaaggacaacgaggugcuguaccgggcccagcuggcgagcgaggacacgaacgcccagaagaccaucaccaacugcuuccuccugaagaacaagaucuggugcaucucccuggucgagaucuacgacaccggcgacaacgugauccgcccgaagcuguucgccgugaagauccccgagcagugcacgugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1501 - RNA, 1838 nt, Artificial Sequence
  mRNA product Design3 comprising derived and/or modified sequence from Hendra henipavirus__NP_047112__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1502 - RNA, 1838 nt, Artificial Sequence
  mRNA product Design3 comprising derived and/or modified sequence from Hendra henipavirus__AEB21225__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucacccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgcguuccugaucgaccggcucaacuggguguccgccggcgucuaccugaacagcaaccagacggccgagaacccgguguucgccguguucaaggacaacgagauccuguaccaggucccccucgccgaggacgacaccaacgcgcagaagaccaucaccgacugcuuccugcuggagaacgugaucuggugcaucucccugguggagaucuacgacacgggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1503 - RNA, 1838 nt, Artificial Sequence
  mRNA product Design3 comprising derived and/or modified sequence from Hendra henipavirus__AEB21216__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccucaucaaggagucccugcagagcguccagcagcagaucaaggcccugaccgacaagaucggcacggagaucggcccgaaggugucccucaucgacaccagcuccaccaucaccauccccgccaacaucgggcugcugggcagcaagaucucccagagcacguccagcaucaacgagaacgugaacgacaagugcaaguucacccucccgccccugaagauccacgagugcaacaucuccugccccaacccccugcccuuccgggaguaccgccccaucagccagggggucuccgaccucgugggccugccgaaccagaucugccugcagaagaccaccagcacgauccucaagccccggcugaucuccuacacccugcccaucaacacccgcgagggggugugcaucaccgacccccuccuggccgucgacaacggcuucuucgcguacagccaccuggagaagaucggcagcugcacgcgggggaucgccaagcagcgcaucaucggcgugggggaggugcucgaccggggcgacaaggucccguccauguucaugaccaacguguggaccccgcccaaccccagcaccauccaccacugcuccagcacguaccacgaggacuucuacuacacccugugcgccgugucccacgucggcgaccccauccugaacagcaccuccuggaccgagagccucucccugauccgccuggccgugcggcccaagagcgacuccggggacuacaaccagaaguacaucgcgaucaacaagguggagcgcggcaaguacgacaaggucaugcccuacgggcccagcggcaucaagcagggggacacgcucuacuucccggccgugggcuuccugccccggaccgaguuccaguacaacgacuccaacugccccaucauccacugcaaguacagcaaggccgagaacugccgccuguccaugggcgugaacagcaagucccacuacauccuccggagcgggcugcugaaguacaaccucucccugggcggggacaucauccugcaguucaucgagaucgccgacaaccgccucaccaucggcagccccagcaagaucuacaacucccuggggcagccggucuucuaccaggccagcuacuccugggacaccaugaucaagcugggcgacguggacacgguggacccccuccggguccaguggcgcaacaacagcgugaucucccggcccggccagagccagugcccccgcuucaacgucugcccggaggugugcugggaggggaccuacaacgacgcguuccugaucgaccggcugaacuggguguccgccggcgucuaccucaacagcaaccagaccgccgagaaccccguguucgccguguucaaggacaacgagauccuguaccaggucccccuggccgaggacgacaccaacgcgcagaagacgaucaccgacugcuuccuccuggagaacgugaucuggugcaucucccugguggagaucuacgacaccggggacagcgucauccgcccgaagcuguucgccgugaagauccccgcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1504 - RNA, 1838 nt, Artificial Sequence
  mRNA product Design3 comprising derived and/or modified sequence from Hendra henipavirus__AEB21206__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccgggaacuacaaccagaaguacaucgcgaucacgaagguggagcgcggcaaguacgacaaggucaugcccuacgggcccagcggcaucaagcagggggacacccuguacuuccccgccgugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugaccaucggcagccccagcaagaucuacaacucccuggggcagcccgucuucuaccaggccagcuacuccugggacacgaugaucaagcucggcgacaucgacaccguggacccgcugcgggugcaguggcgcaacaacagcgucaucucccggcccggccagagccagugcccccgcuucaacgugugccccgaggucugcugggaggggaccuacaacgacgcguuccugaucgaccggcucaacuggguguccgccggcguguaccugaacagcaaccagaccgccgagaacccggucuucgccguguucaaggacaacgagauccuguaccaggugccccucgccgaggacgacacgaacgcgcagaagaccaucaccgacugcuuccugcuggagaacgucaucuggugcaucucccugguggagaucuacgacaccggggacagcgugauccgccccaagcuguucgccgucaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1505 - RNA, 1838 nt, Artificial Sequence
  mRNA product Design3 comprising derived and/or modified sequence from Hendra henipavirus__AEQ38052__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcagggggacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1506 - RNA, 1838 nt, Artificial Sequence
  mRNA product Design3 comprising derived and/or modified sequence from Hendra henipavirus__AEQ38115__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacaacggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggaccuacaacgacgcguuccugaucgaccggcucaacugggugagcgccggcgucuaccugaacuccaaccagaccgccgagaacccgguguucgccguguucaaggacaacgagauccuguaccaggucccccucgccgaggacgacacgaacgcgcagaagaccaucaccgacugcuuccugcuggagaacgugaucuggugcaucagccugguggagaucuacgacaccggggacuccgucauccgccccaagcuguucgccgugaagaucccggcccagugcagcgaguccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1507 - RNA, 1838 nt, Artificial Sequence
  mRNA product Design3 comprising derived and/or modified sequence from Hendra henipavirus__AEQ38108__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagagcacguccagcaucaacgagaacgugaacgacaagugcaaguucacccugccgccccugaagauccacgagugcaacaucuccugccccaacccgcuccccuuccgggaguaccgccccaucagccagggggucuccgaccuggugggccugcccaaccagaucugccuccagaagaccaccagcacgauccugaagccgcggcugaucuccuacacccuccccaucaacacccgcgagggggugugcaucaccgacccccugcuggccgucgacaacggcuucuucgcguacagccaccucgagaagaucggcagcugcacgcgggggaucgccaagcagcgcaucaucggcgugggggaggugcuggaccggggcgacaagguccccuccauguucaugaccaacguguggaccccgcccaaccccagcaccauccaccacugcuccagcacguaccacgaggacuucuacuacacccugugcgccgugucccacgucggcgaccccauccucaacagcaccuccuggaccgagagccugucccugauccgccucgccgugcggcccaagagcgacuccggggacuacaaccagaaguacaucacgaucaccaagguggagcgcggcaaguacgacaaggucaugcccuacgggcccagcggcaucaagcaggggaacacccuguacuuccccgcggugggcuuccugccgcggaccgaguuccaguacaacgacuccaacugccccaucauccacugcaaguacagcaaggccgagaacugccgccucuccaugggcgugaacagcaagucccacuacauccugcggagcgggcugcucaaguacaaccugucccugggcggggacaucauccuccaguucaucgagaucgccgacaaccgccugacgaucggcagccccagcaagaucuacaacucccuggggcagcccgucuucuaccaggccagcuacuccugggacaccaugaucaagcucggcgacguggacaccguggacccgcugcggguccaguggcgcaacaacagcgugaucucccggcccggccagagccagugcccccgcuucaacgucugccccgaggugugcugggaggggaccuacaacgacgccuuccugaucgaccggcucaacuggguguccgcgggcgucuaccugaacagcaaccagacggccgagaacccgguguucgccguguucaaggacaacgagauccuguaccaggucccccucgccgaggacgacaccaacgcccagaagaccaucaccgacugcuuccugcuggagaacgugaucuggugcaucucccugguggagaucuacgacacgggggacagcgucauccgccccaagcuguucgcggugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1508 - RNA, 1838 nt, Artificial Sequence
  mRNA product Design3 comprising derived and/or modified sequence from Hendra henipavirus__AAV80426__H1N1-HA(1-17)_G(70-604) (opt1)
gggagaaagcuuaccaugaaggccauccuggugguccuccuguacaccuucgccaccgcgaacgcccagaacuacacgcgcaccaccgacaaccaggcccugaucaaggagucccugcagagcguccagcagcagaucaaggcccucaccgacaagaucggcacggagaucggccccaaggugucccugaucgacaccagcuccaccaucaccaucccggccaacaucgggcugcucggcagcaagaucucccagugcacgagcuccaucaacgagaacgugaacgacaagugcaaguucacccugccgccccugaagauccacgagugcaacaucagcugccccaacccccuccccuuccgggaguaccgccccaucucccagggggucagcgaccuggugggccugcccaaccagaucugccuccagaagaccaccuccacgauccugaagccgcggcugaucagcuacacccuccccaucaacacccgcgagggggugugcaucaccgacccccugcuggccgucgacaacggcuucuucgcguacucccaccucgagaagaucggcagcugcacgcgggggaucgccaagcagcgcaucaucggcgugggggaggugcuggaccggggcgacaagguccccagcauguucaugaccaacguguggaccccgcccaaccccuccaccauccaccacugcagcuccacguaccacgaggacuucuacuacacccugugcgccgugagccacgucggcgaccccauccucaacuccaccagcuggaccgagucccugagccugauccgccucgccgugcggccgaaguccgacagcggggacuacaaccagaaguacaucgcgaucacgaagguggagcgcggcaaguacgacaaggucaugcccuacgggcccuccggcaucaagcagggggacacccuguacuuccccgccgugggcuuccugccgcggaccgaguuccaguacaacgacagcaacugccccaucauccacugcaaguacuccaaggccgagaacugccgccucagcaugggcgugaacuccaagagccacuacauccugcgguccgggcugcucaaguacaaccugagccugggcggggacaucauccuccaguucaucgagaucgccgacaaccgccugaccaucggcucccccagcaagaucuacaacagccuggggcagcccgucuucuaccaggccuccuacagcugggacacgaugaucaagcucggcgacguggacaccguggacccgcugcggguccaguggcgcaacaacuccgugaucagccggcccggccagucccagugcccccgcuucaacgucugccccgaggugugcugggaggggagcuacaacgacgcguuccugaucgaccggcucaacuggguguccgccggcgucuaccugaacagcaaccagaccgccgagaacccgguguucgccguguucaaggacaacgagauccuguaccaggucccccucgccgaggacgacaccaacgcgcagaagacgaucaccgacugcuuccugcuggagaacgugaucuggugcaucucccugguggagaucuacgacaccggggacagcgucauccgccccaagcuguucgccgugaagaucccggcccagugcuccgagagcugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1509 - RNA, 99 nt, Artificial Sequence
  3'-end A75-histoneSL
aaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1510 - RNA, 102 nt, Artificial Sequence
  3'-end U3-A75-histoneSL
uuuaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1511 - RNA, 178 nt, Artificial Sequence
  3'-end A154-histoneSL
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1512 - RNA, 181 nt, Artificial Sequence
  3'-end U3-A154-histoneSL
uuuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1513 - protein, 537 aa, Artificial Sequence
  derived and/or modified protein sequence (wt) from Nipah henipavirus__AAY43915__HsSPARC(1-17)_F(27-546)
MRAWIFFLLCLAGRALAILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYSSDLLFVFGPNLQDPVSNSMTIQAISQAFGGNYETLLRTLGYATEGFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1514 - protein, 538 aa, Artificial Sequence
  derived and/or modified protein sequence (wt) from Nipah henipavirus__AAY43915__HsCTRB2(1-18)_F(27-546)
MAFLWLLSCWALLGTTFGILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYSSDLLFVFGPNLQDPVSNSMTIQAISQAFGGNYETLLRTLGYATEGFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1515 - protein, 546 aa, Artificial Sequence
  derived and/or modified protein sequence (wt) from Nipah henipavirus__AAY43915__Nipah henipavirus__AAK50553__F(1-26)_F(27-546)
MVVILDKRCYCNLLILILMISECSVGILHYEKLSKIGLVKGITRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYSSDLLFVFGPNLQDPVSNSMTIQAISQAFGGNYETLLRTLGYATEGFDDLLESDSITGQIIYVDLSGYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 1516 - RNA, 1614 nt, Artificial Sequence
  derived and/or modified CDS sequence (wt) from Nipah henipavirus__AAY43915__HsSPARC(1-17)_F(27-546)
augagggccuggaucuucuuucuccuuugccuggccgggagggcucuggcaauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguacuccucugauuugcuuuuuguauuuggucccaaccuucaagacccaguuucuaauucaaugacuauacaggcuauaucucaggcauucgguggaaauuaugaaacacugcuaagaacguuggguuacgcuacagaaggcuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcuaaugauugauaacaccaccuguccuacagcuguacucgguaaugugaucaucagcuuggggaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 1517 - RNA, 1617 nt, Artificial Sequence
  derived and/or modified CDS sequence (wt) from Nipah henipavirus__AAY43915__HsCTRB2(1-18)_F(27-546)
auggcuuuccucuggcuccucuccugcugggcccuccuggguaccaccuucggcauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguacuccucugauuugcuuuuuguauuuggucccaaccuucaagacccaguuucuaauucaaugacuauacaggcuauaucucaggcauucgguggaaauuaugaaacacugcuaagaacguuggguuacgcuacagaaggcuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcuaaugauugauaacaccaccuguccuacagcuguacucgguaaugugaucaucagcuuggggaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 1518 - RNA, 1641 nt, Artificial Sequence
  derived and/or modified CDS sequence (wt) from Nipah henipavirus__AAY43915__Nipah henipavirus__AAK50553__F(1-26)_F(27-546)
augguaguuauacuugacaagagauguuauuguaaucuuuuaauauugauuuugaugaucucggaguguaguguugggauuuugcauuaugagaaauugaguaagauugggcuugucaaaggaauaacaagaaaauacaagaucaaaagcaauccucucacaaaagacauuguuauuaaaaugauuccgaaugugucaaacaugucucaaugcacggggagugucauggaaaauuauaaaacacgauuaaacgguauccuaacgccuauaaagggggcauuagagauuuacaagaacaacacucaugaccuugucggugauguaagacuggccggaguuauaauggcaggaguugcuauuggaauugcaaccgcagcucaaauuacugcagguguagcauuauaugaggcaaugaaaaaugcugacaacaucaacaaacucaaaagcagcauagaaucaacuaaugaagcuguuguuaagcuucaagagacugcagaaaagacagucuauguacugaccgcuuugcaggauuacauuaauacuaacuugguaccgacaauugacaagauaagcugcaaacagacggaacucucauuagaucuagcacuaucaaaguacuccucugauuugcuuuuuguauuuggucccaaccuucaagacccaguuucuaauucaaugacuauacaggcuauaucucaggcauucgguggaaauuaugaaacacugcuaagaacguuggguuacgcuacagaaggcuuugaugaucuucuagaaagugacagcauaacgggucaaauuaucuacguugauuuaaguggcuacuacauaauugucaggguuuauuuuccuauccugacugaaauccaacaggccuauauccaagaauuguugccagugagcuuuaacaaugacaauucagaauggaucagcauugucccaaauuucauauugguaaggaacacauuaauaucaaauauagagauuggauuuugccuaauuacaaagaggagugugaucugcaaccaagauuaugcaacacccaugacaaacaauaugagggaauguuugacggggucgacugagaaguguccucgagagcugguuguuucaucacacguucccagauuugcacuaucuaacgggguuuuguuugcuaauugcauaagcgucacaugccagugucaaacaacagguagggcaaucucacagucaggagaacaaacucugcuaaugauugauaacaccaccuguccuacagcuguacucgguaaugugaucaucagcuuggggaaauaucuugggucaguaaauuauaacucugaaggcauugcuauugguccuccugucuuuacugauaaaguugacauaucaagucaaauaucuagcaugaaucaguccuuacaacaaucuaaggacuauaucaaagaagcucaacgacuccuugauacuguuaacccgucauuaauaagcauguugucuaugaucauacuguauguacuaucaauugcaucauuguguauaggauugauuacauuuaucaguuuuaucauuguugagaaaaaaagaaacaccuauagcagauuagaggacaggagagucagaccuacaaguaguggggaucucuauuacauugggacguag

SEQ ID NO: 1519 - RNA, 1614 nt, Artificial Sequence
  derived and/or modified CDS sequence (opt1) from Nipah henipavirus__AAY43915__HsSPARC(1-17)_F(27-546)
augcgcgccuggaucuucuuccugcucugccuggccggccgggcccuggccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccuga

SEQ ID NO: 1520 - RNA, 1617 nt, Artificial Sequence
  derived and/or modified CDS sequence (opt1) from Nipah henipavirus__AAY43915__HsCTRB2(1-18)_F(27-546)
auggccuuccuguggcuccugagcugcugggcccugcucggcaccaccuucgggauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccuga

SEQ ID NO: 1521 - RNA, 1641 nt, Artificial Sequence
  derived and/or modified CDS sequence (opt1) from Nipah henipavirus__AAY43915__Nipah henipavirus__AAK50553__F(1-26)_F(27-546)
augguggucauccuggacaagcgcugcuacugcaaccuccugauccugauccucaugaucagcgagugcuccgugggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccuga

SEQ ID NO: 1522 - RNA, 1614 nt, Artificial Sequence
  derived and/or modified CDS sequence (opt2) from Nipah henipavirus__AAY43915__HsSPARC(1-17)_F(27-546)
augcgcgccuggaucuucuuccuccucugccucgccggccgcgcccucgccauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguacuccuccgaccuccucuucgucuucggccccaaccuccaggaccccgucuccaacuccaugaccauccaggccaucucccaggccuucggcggcaacuacgagacccuccuccgcacccucggcuacgccaccgagggcuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1523 - RNA, 1617 nt, Artificial Sequence
  derived and/or modified CDS sequence (opt2) from Nipah henipavirus__AAY43915__HsCTRB2(1-18)_F(27-546)
auggccuuccucuggcuccucuccugcugggcccuccucggcaccaccuucggcauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguacuccuccgaccuccucuucgucuucggccccaaccuccaggaccccgucuccaacuccaugaccauccaggccaucucccaggccuucggcggcaacuacgagacccuccuccgcacccucggcuacgccaccgagggcuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1524 - RNA, 1641 nt, Artificial Sequence
  derived and/or modified CDS sequence (opt2) from Nipah henipavirus__AAY43915__Nipah henipavirus__AAK50553__F(1-26)_F(27-546)
auggucgucauccucgacaagcgcugcuacugcaaccuccucauccucauccucaugaucuccgagugcuccgucggcauccuccacuacgagaagcucuccaagaucggccucgucaagggcaucacccgcaaguacaagaucaaguccaacccccucaccaaggacaucgucaucaagaugauccccaacgucuccaacaugucccagugcaccggcuccgucauggagaacuacaagacccgccucaacggcauccucacccccaucaagggcgcccucgagaucuacaagaacaacacccacgaccucgucggcgacguccgccucgccggcgucaucauggccggcgucgccaucggcaucgccaccgccgcccagaucaccgccggcgucgcccucuacgaggccaugaagaacgccgacaacaucaacaagcucaaguccuccaucgaguccaccaacgaggccgucgucaagcuccaggagaccgccgagaagaccgucuacguccucaccgcccuccaggacuacaucaacaccaaccucguccccaccaucgacaagaucuccugcaagcagaccgagcucucccucgaccucgcccucuccaaguacuccuccgaccuccucuucgucuucggccccaaccuccaggaccccgucuccaacuccaugaccauccaggccaucucccaggccuucggcggcaacuacgagacccuccuccgcacccucggcuacgccaccgagggcuucgacgaccuccucgaguccgacuccaucaccggccagaucaucuacgucgaccucuccggcuacuacaucaucguccgcgucuacuuccccauccucaccgagauccagcaggccuacauccaggagcuccuccccgucuccuucaacaacgacaacuccgaguggaucuccaucguccccaacuucauccucguccgcaacacccucaucuccaacaucgagaucggcuucugccucaucaccaagcgcuccgucaucugcaaccaggacuacgccacccccaugaccaacaacaugcgcgagugccucaccggcuccaccgagaagugcccccgcgagcucgucgucuccucccacgucccccgcuucgcccucuccaacggcguccucuucgccaacugcaucuccgucaccugccagugccagaccaccggccgcgccaucucccaguccggcgagcagacccuccucaugaucgacaacaccaccugccccaccgccguccucggcaacgucaucaucucccucggcaaguaccucggcuccgucaacuacaacuccgagggcaucgccaucggcccccccgucuucaccgacaaggucgacaucuccucccagaucuccuccaugaaccagucccuccagcaguccaaggacuacaucaaggaggcccagcgccuccucgacaccgucaaccccucccucaucuccaugcucuccaugaucauccucuacguccucuccaucgccucccucugcaucggccucaucaccuucaucuccuucaucaucgucgagaagaagcgcaacaccuacucccgccucgaggaccgccgcguccgccccaccuccuccggcgaccucuacuacaucggcaccuga

SEQ ID NO: 1525 - RNA, 1614 nt, Artificial Sequence
  derived and/or modified CDS sequence (opt3) from Nipah henipavirus__AAY43915__HsSPARC(1-17)_F(27-546)
augagagccuggaucuucuuucugcucugccuugcuggcagggcacuggccauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauacagcuccgaucugcuuuucguguuuggccccaaucugcaagacccugugucaaacaguaugaccauucaggccaucagccaggcuuucggcgggaacuaugaaacauugcuccgaacucugggauacgccaccgaggguuuugaugacuuacuggagucugauuccauaacaggccagauuaucuaugucgaccucucaggguacuauaucauuguucguguguacuucccaauccuuaccgaaauucaacaggcauauauacaggagcuguugcccguaaguuuuaauaacgauaauagugaauggaucucuauugugccuaacuucauccuagucagaaauacgcugaucuccaacauugagauaggauuuugucucaucacuaagaggagcgugauuugcaaucaggacuacgcuacaccaaugaccaacaauaugcgggaaugucugacuggcucgacagagaaaugcccccgcgagcuuguugugucuucccacgucccuagauucgcccugucaaacgguguguuguuugcgaauuguaucaguguaaccugccaaugucagacgaccgggagggccauuagccaguccggagaacaaacacuccugaugaucgacaacacuaccugcccaacagcaguuuuaggcaaugugauaaucucucugggcaaguaccuagggagcgucaacuauaauucagagggaauugcuaucgguccgcccguguucacugauaaggucgacauuaguucccagaucagcucuaugaaccagucacuccagcaaaguaaagauuacauaaaggaagcccagcggcugcuugacaccgugaacccuagcuugauuuccaugcugucuaugaucauucucuauguucugucgaucgcuagccuuuguauaggccugaucacauuuauuuccuucaucauuguggagaaaaagcgcaauaccuacucacgauuggaagauagaaggguacggccaacuagcucuggggaccucuauuacaucggaacguga

SEQ ID NO: 1526 - RNA, 1617 nt, Artificial Sequence
  derived and/or modified CDS sequence (opt3) from Nipah henipavirus__AAY43915__HsCTRB2(1-18)_F(27-546)
auggccuuccuguggcuccuuagcugcugggcucuguugggcaccacauuugggauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauacagcuccgaucugcuuuucguguuuggccccaaucugcaagacccugugucaaacaguaugaccauucaggccaucagccaggcuuucggcgggaacuaugaaacauugcuccgaacucugggauacgccaccgaggguuuugaugacuuacuggagucugauuccauaacaggccagauuaucuaugucgaccucucaggguacuauaucauuguucguguguacuucccaauccuuaccgaaauucaacaggcauauauacaggagcuguugcccguaaguuuuaauaacgauaauagugaauggaucucuauugugccuaacuucauccuagucagaaauacgcugaucuccaacauugagauaggauuuugucucaucacuaagaggagcgugauuugcaaucaggacuacgcuacaccaaugaccaacaauaugcgggaaugucugacuggcucgacagagaaaugcccccgcgagcuuguugugucuucccacgucccuagauucgcccugucaaacgguguguuguuugcgaauuguaucaguguaaccugccaaugucagacgaccgggagggccauuagccaguccggagaacaaacacuccugaugaucgacaacacuaccugcccaacagcaguuuuaggcaaugugauaaucucucugggcaaguaccuagggagcgucaacuauaauucagagggaauugcuaucgguccgcccguguucacugauaaggucgacauuaguucccagaucagcucuaugaaccagucacuccagcaaaguaaagauuacauaaaggaagcccagcggcugcuugacaccgugaacccuagcuugauuuccaugcugucuaugaucauucucuauguucugucgaucgcuagccuuuguauaggccugaucacauuuauuuccuucaucauuguggagaaaaagcgcaauaccuacucacgauuggaagauagaaggguacggccaacuagcucuggggaccucuauuacaucggaacguga

SEQ ID NO: 1527 - RNA, 1641 nt, Artificial Sequence
  derived and/or modified CDS sequence (opt3) from Nipah henipavirus__AAY43915__Nipah henipavirus__AAK50553__F(1-26)_F(27-546)
augguggucauccuggacaagagaugcuacuguaaccuccuuauucugauauugaugaucagcgagugcuccguuggcauuuuacacuacgaaaaacugucaaagaucgggcuaguuaaaggaauuaccaggaaguauaaaaucaagaguaacccccucacaaaggacauagugaucaaaaugauuccuaauguaagcaacaugucccaguguacugguucugugauggagaauuacaagacgcggcugaacggcauccuuaccccaauuaaaggggcucuggaaaucuauaagaauaacacacaugauuuggucggagacgugcgccucgcaggcguuauaauggccgguguggcgauugggaucgcuacugccgcacaaauuaccgccggagucgcucuguacgaggcaaugaaaaaugccgauaacaucaauaagcugaagucgucaaucgaaagcacaaacgaggcugugguaaaacuccaggagaccgccgaaaagacuguuuauguguuaacagcgcugcaggacuacauuaauaccaaccuugucccgacgauagauaaaaucaguugcaagcagacugaguugucccuggaccuagcacucucuaaauacagcuccgaucugcuuuucguguuuggccccaaucugcaagacccugugucaaacaguaugaccauucaggccaucagccaggcuuucggcgggaacuaugaaacauugcuccgaacucugggauacgccaccgaggguuuugaugacuuacuggagucugauuccauaacaggccagauuaucuaugucgaccucucaggguacuauaucauuguucguguguacuucccaauccuuaccgaaauucaacaggcauauauacaggagcuguugcccguaaguuuuaauaacgauaauagugaauggaucucuauugugccuaacuucauccuagucagaaauacgcugaucuccaacauugagauaggauuuugucucaucacuaagaggagcgugauuugcaaucaggacuacgcuacaccaaugaccaacaauaugcgggaaugucugacuggcucgacagagaaaugcccccgcgagcuuguugugucuucccacgucccuagauucgcccugucaaacgguguguuguuugcgaauuguaucaguguaaccugccaaugucagacgaccgggagggccauuagccaguccggagaacaaacacuccugaugaucgacaacacuaccugcccaacagcaguuuuaggcaaugugauaaucucucugggcaaguaccuagggagcgucaacuauaauucagagggaauugcuaucgguccgcccguguucacugauaaggucgacauuaguucccagaucagcucuaugaaccagucacuccagcaaaguaaagauuacauaaaggaagcccagcggcugcuugacaccgugaacccuagcuugauuuccaugcugucuaugaucauucucuauguucugucgaucgcuagccuuuguauaggccugaucacauuuauuuccuucaucauuguggagaaaaagcgcaauaccuacucacgauuggaagauagaaggguacggccaacuagcucuggggaccucuauuacaucggaacguga

SEQ ID NO: 1528 - RNA, 1614 nt, Artificial Sequence
  derived and/or modified CDS sequence (opt4) from Nipah henipavirus__AAY43915__HsSPARC(1-17)_F(27-546)
augagagccuggaucuucuuccugcugugccuggccggcagagcccuggccauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguacagcagcgaccugcuguucguguucggccccaaccugcaggaccccgugagcaacagcaugaccauccaggccaucagccaggccuucggcggcaacuacgagacccugcugagaacccugggcuacgccaccgagggcuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1529 - RNA, 1617 nt, Artificial Sequence
  derived and/or modified CDS sequence (opt4) from Nipah henipavirus__AAY43915__HsCTRB2(1-18)_F(27-546)
auggccuuccuguggcugcugagcugcugggcccugcugggcaccaccuucggcauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguacagcagcgaccugcuguucguguucggccccaaccugcaggaccccgugagcaacagcaugaccauccaggccaucagccaggccuucggcggcaacuacgagacccugcugagaacccugggcuacgccaccgagggcuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1530 - RNA, 1641 nt, Artificial Sequence
  derived and/or modified CDS sequence (opt4) from Nipah henipavirus__AAY43915__Nipah henipavirus__AAK50553__F(1-26)_F(27-546)
augguggugauccuggacaagagaugcuacugcaaccugcugauccugauccugaugaucagcgagugcagcgugggcauccugcacuacgagaagcugagcaagaucggccuggugaagggcaucaccagaaaguacaagaucaagagcaacccccugaccaaggacaucgugaucaagaugauccccaacgugagcaacaugagccagugcaccggcagcgugauggagaacuacaagaccagacugaacggcauccugacccccaucaagggcgcccuggagaucuacaagaacaacacccacgaccuggugggcgacgugagacuggccggcgugaucauggccggcguggccaucggcaucgccaccgccgcccagaucaccgccggcguggcccuguacgaggccaugaagaacgccgacaacaucaacaagcugaagagcagcaucgagagcaccaacgaggccguggugaagcugcaggagaccgccgagaagaccguguacgugcugaccgcccugcaggacuacaucaacaccaaccuggugcccaccaucgacaagaucagcugcaagcagaccgagcugagccuggaccuggcccugagcaaguacagcagcgaccugcuguucguguucggccccaaccugcaggaccccgugagcaacagcaugaccauccaggccaucagccaggccuucggcggcaacuacgagacccugcugagaacccugggcuacgccaccgagggcuucgacgaccugcuggagagcgacagcaucaccggccagaucaucuacguggaccugagcggcuacuacaucaucgugagaguguacuuccccauccugaccgagauccagcaggccuacauccaggagcugcugcccgugagcuucaacaacgacaacagcgaguggaucagcaucgugcccaacuucauccuggugagaaacacccugaucagcaacaucgagaucggcuucugccugaucaccaagagaagcgugaucugcaaccaggacuacgccacccccaugaccaacaacaugagagagugccugaccggcagcaccgagaagugccccagagagcugguggugagcagccacgugcccagauucgcccugagcaacggcgugcuguucgccaacugcaucagcgugaccugccagugccagaccaccggcagagccaucagccagagcggcgagcagacccugcugaugaucgacaacaccaccugccccaccgccgugcugggcaacgugaucaucagccugggcaaguaccugggcagcgugaacuacaacagcgagggcaucgccaucggcccccccguguucaccgacaagguggacaucagcagccagaucagcagcaugaaccagagccugcagcagagcaaggacuacaucaaggaggcccagagacugcuggacaccgugaaccccagccugaucagcaugcugagcaugaucauccuguacgugcugagcaucgccagccugugcaucggccugaucaccuucaucagcuucaucaucguggagaagaagagaaacaccuacagcagacuggaggacagaagagugagacccaccagcagcggcgaccuguacuacaucggcaccuga

SEQ ID NO: 1531 - RNA, 1614 nt, Artificial Sequence
  derived and/or modified CDS sequence (opt5) from Nipah henipavirus__AAY43915__HsSPARC(1-17)_F(27-546)
augagagccuggaucuucuuucugcucugccuggcuggccgggcccuugcgauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauacagcucugaucugcuuuucgucuuugggccuaaucugcaagaccccguuuccaacagcaugaccauccaggccauuucucaggcguucggaggcaacuaugaaacgcuccugcggacacuuggguacgccaccgagggauuugaugaccugcucgaguccgauagcaucacaggccagauuaucuauguggaccuguccggguacuauauuaucgugcgcgucuacuucccuauccugaccgaaauucaacaggcuuauauccaggagcuccugcccgugucuuuuaauaacgauaauagcgaauggauuuccaucguuccuaacuucauucuugugagaaauacccugaucagcaacauugagaucggauuuugucucaucacaaagcggucugucauuugcaaucaggacuacgccacgccgaugaccaacaauaugcgcgaaugucugacaggcuccaccgagaaaugccccagagagcuugugguuagcucucacgugccucgguucgcucugagcaacggcguccucuuugccaauuguaucuccgugacaugccaaugucagaccacggggcgcgccauuucucagagcggagaacaaacacugcugaugaucgacaacacaaccugccccaccgcuguccucggcaaugugauuaucucccuggggaaguaccuuggaagcguuaacuauaauucugagggcaucgcgauugggccucccguguucaccgauaaggucgacaucuccagccagauuucuuccaugaaccagagccugcagcaauccaaagauuacaucaaggaagcccagagacuccuggacacagugaacccgucucugauuagcaugcuuuccaugaucauccucuauguucugucuauugcuagccuguguaucggacucauuacguuuaucuccuucauuaucguggagaaaaagcggaauaccuacagccgccuggaagauagacggguccgcccuacaucuuccggcgaccuuuauuacaucggcaccuga

SEQ ID NO: 1532 - RNA, 1617 nt, Artificial Sequence
  derived and/or modified CDS sequence (opt5) from Nipah henipavirus__AAY43915__HsCTRB2(1-18)_F(27-546)
auggcuuuccuguggcuccugagcugcugggcccuucugggcaccacauuugggauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauacagcucugaucugcuuuucgucuuugggccuaaucugcaagaccccguuuccaacagcaugaccauccaggccauuucucaggcguucggaggcaacuaugaaacgcuccugcggacacuuggguacgccaccgagggauuugaugaccugcucgaguccgauagcaucacaggccagauuaucuauguggaccuguccggguacuauauuaucgugcgcgucuacuucccuauccugaccgaaauucaacaggcuuauauccaggagcuccugcccgugucuuuuaauaacgauaauagcgaauggauuuccaucguuccuaacuucauucuugugagaaauacccugaucagcaacauugagaucggauuuugucucaucacaaagcggucugucauuugcaaucaggacuacgccacgccgaugaccaacaauaugcgcgaaugucugacaggcuccaccgagaaaugccccagagagcuugugguuagcucucacgugccucgguucgcucugagcaacggcguccucuuugccaauuguaucuccgugacaugccaaugucagaccacggggcgcgccauuucucagagcggagaacaaacacugcugaugaucgacaacacaaccugccccaccgcuguccucggcaaugugauuaucucccuggggaaguaccuuggaagcguuaacuauaauucugagggcaucgcgauugggccucccguguucaccgauaaggucgacaucuccagccagauuucuuccaugaaccagagccugcagcaauccaaagauuacaucaaggaagcccagagacuccuggacacagugaacccgucucugauuagcaugcuuuccaugaucauccucuauguucugucuauugcuagccuguguaucggacucauuacguuuaucuccuucauuaucguggagaaaaagcggaauaccuacagccgccuggaagauagacggguccgcccuacaucuuccggcgaccuuuauuacaucggcaccuga

SEQ ID NO: 1533 - RNA, 1641 nt, Artificial Sequence
  derived and/or modified CDS sequence (opt5) from Nipah henipavirus__AAY43915__Nipah henipavirus__AAK50553__F(1-26)_F(27-546)
augguggucauccuggacaagagaugcuacuguaaccuccugauucuuauccugaugauuagcgagugcuccguuggcauccuccacuacgaaaaacugagcaagauugggcuuguuaaaggaaucacccggaaguauaaaaucaaguccaacccccugacaaaggacauugugaucaaaaugauuccuaaugugucuaacaugagccaguguacgggcuccgucauggagaauuacaagacccgccucaacgggauccugacaccgauuaaaggagcucuggaaaucuauaagaauaacacccaugaucucgugggcgacguuagacuggccggggugauuauggcgggagucgcuaucggcaucgccacagccgcucaaauuaccgccggcguggcucuuuacgaggccaugaaaaaugcggauaacaucaauaagcugaagucuagcauugaauccacaaacgaggccguugugaaacuccaggagaccgcugaaaagacggucuaugugcugaccgcccuucaggacuacaucaauacaaaccuggugcccaccauugauaaaaucagcugcaagcagacagagcucucucuggaccuggcucucuccaaauacagcucugaucugcuuuucgucuuugggccuaaucugcaagaccccguuuccaacagcaugaccauccaggccauuucucaggcguucggaggcaacuaugaaacgcuccugcggacacuuggguacgccaccgagggauuugaugaccugcucgaguccgauagcaucacaggccagauuaucuauguggaccuguccggguacuauauuaucgugcgcgucuacuucccuauccugaccgaaauucaacaggcuuauauccaggagcuccugcccgugucuuuuaauaacgauaauagcgaauggauuuccaucguuccuaacuucauucuugugagaaauacccugaucagcaacauugagaucggauuuugucucaucacaaagcggucugucauuugcaaucaggacuacgccacgccgaugaccaacaauaugcgcgaaugucugacaggcuccaccgagaaaugccccagagagcuugugguuagcucucacgugccucgguucgcucugagcaacggcguccucuuugccaauuguaucuccgugacaugccaaugucagaccacggggcgcgccauuucucagagcggagaacaaacacugcugaugaucgacaacacaaccugccccaccgcuguccucggcaaugugauuaucucccuggggaaguaccuuggaagcguuaacuauaauucugagggcaucgcgauugggccucccguguucaccgauaaggucgacaucuccagccagauuucuuccaugaaccagagccugcagcaauccaaagauuacaucaaggaagcccagagacuccuggacacagugaacccgucucugauuagcaugcuuuccaugaucauccucuauguucugucuauugcuagccuguguaucggacucauuacguuuaucuccuucauuaucguggagaaaaagcggaauaccuacagccgccuggaagauagacggguccgcccuacaucuuccggcgaccuuuauuacaucggcaccuga

SEQ ID NO: 1534 - RNA, 1614 nt, Artificial Sequence
  derived and/or modified CDS sequence (opt6) from Nipah henipavirus__AAY43915__HsSPARC(1-17)_F(27-546)
augcgugcauggauauuuuuucuuuuauguuuggcuggacgugcacuugcaauacuccacuaugaaaaauuaucaaaaauaggauuagucaaaggaauaacaagaaaauauaaaaucaaaucaaauccccuaacaaaagauaucguaauuaaaaugauaccaaauguaucaaauaugagucaaugcaccggaagcguaauggaaaauuauaaaacacgcuuaaacggaauacuaaccccaaucaaaggagcuuuagaaauuuauaaaaacaacacacaugauuuaguaggcgauguaagacuagcaggcguaauuauggcuggcguugcaauaggaauagcuacagcugcccaaauaaccgcuggagucgcacucuaugaagcaaugaaaaacgcugacaacauaaauaaacuaaaaucaucaauagaaagcaccaaugaagccgucguaaaacuacaagaaacagcagaaaaaacaguauacguauuaaccgcuuuacaagacuauauaaauacuaacuuaguccccacaauugacaaaauuuccugcaaacagacagaacuaucacucgauuuagcauuaucaaaauacucuuccgacuuacuauucguauucgguccuaaucuacaagacccagucuccaacuccaugacuauccaagcaauaucccaagcauuuggaggaaauuaugaaacacucuuaagaacccucggauacgcaacagaaggcuucgaugaccuacucgaauccgacaguaucacaggacaaauaauauauguagacuuaucuggauacuauauaauaguaagaguauacuuuccaauucuaacagaaauacaacaagccuacauccaagaacuauuaccuguuucauuuaacaaugacaacuccgaauggauaucaauaguacccaauuucauccuuguuaggaacacccuaauauccaacauugaaaucggauuuuguuuaauaaccaaacgaucagucaucugcaaccaagauuaugcaacaccaaugaccaacaacaugagagaaugccuaacaggaucaacagaaaaauguccacgagaacuaguagucucaucccauguaccaagauucgccuuaucuaacgguguacuauucgcaaacugcaucaguguuaccugccaaugucaaaccacaggcagagccauaucucaaucuggagaacaaacacuacucaugauagacaauacaacuuguccaaccgcaguauuaggcaacguuauaauaucauuaggaaaauaccuaggaagugucaacuauaacucagaaggaauugcuauaggaccacccguauucacagauaaaguagacauauccucacaaauaucauccaugaaccaaucauuacaacaaucuaaagauuacauaaaagaagcacaaagacuauuagacacaguaaauccaucauuaauaucuaugcuaucaaugauaauacuauauguccucucaauugcuucacuuugcauaggccuaauaaccuuuaucucauucauaauaguagaaaaaaaacgaaacacauacuccagacuagaagacagacgaguuagacccacauccucaggugaccuauauuacauaggaacauaa

SEQ ID NO: 1535 - RNA, 1617 nt, Artificial Sequence
  derived and/or modified CDS sequence (opt6) from Nipah henipavirus__AAY43915__HsCTRB2(1-18)_F(27-546)
auggcuuuuuuaugguuauuaucuuguugggcuuuauuagguacuacuuuugguauacuccacuaugaaaaauuaucaaaaauaggauuagucaaaggaauaacaagaaaauauaaaaucaaaucaaauccccuaacaaaagauaucguaauuaaaaugauaccaaauguaucaaauaugagucaaugcaccggaagcguaauggaaaauuauaaaacacgcuuaaacggaauacuaaccccaaucaaaggagcuuuagaaauuuauaaaaacaacacacaugauuuaguaggcgauguaagacuagcaggcguaauuauggcuggcguugcaauaggaauagcuacagcugcccaaauaaccgcuggagucgcacucuaugaagcaaugaaaaacgcugacaacauaaauaaacuaaaaucaucaauagaaagcaccaaugaagccgucguaaaacuacaagaaacagcagaaaaaacaguauacguauuaaccgcuuuacaagacuauauaaauacuaacuuaguccccacaauugacaaaauuuccugcaaacagacagaacuaucacucgauuuagcauuaucaaaauacucuuccgacuuacuauucguauucgguccuaaucuacaagacccagucuccaacuccaugacuauccaagcaauaucccaagcauuuggaggaaauuaugaaacacucuuaagaacccucggauacgcaacagaaggcuucgaugaccuacucgaauccgacaguaucacaggacaaauaauauauguagacuuaucuggauacuauauaauaguaagaguauacuuuccaauucuaacagaaauacaacaagccuacauccaagaacuauuaccuguuucauuuaacaaugacaacuccgaauggauaucaauaguacccaauuucauccuuguuaggaacacccuaauauccaacauugaaaucggauuuuguuuaauaaccaaacgaucagucaucugcaaccaagauuaugcaacaccaaugaccaacaacaugagagaaugccuaacaggaucaacagaaaaauguccacgagaacuaguagucucaucccauguaccaagauucgccuuaucuaacgguguacuauucgcaaacugcaucaguguuaccugccaaugucaaaccacaggcagagccauaucucaaucuggagaacaaacacuacucaugauagacaauacaacuuguccaaccgcaguauuaggcaacguuauaauaucauuaggaaaauaccuaggaagugucaacuauaacucagaaggaauugcuauaggaccacccguauucacagauaaaguagacauauccucacaaauaucauccaugaaccaaucauuacaacaaucuaaagauuacauaaaagaagcacaaagacuauuagacacaguaaauccaucauuaauaucuaugcuaucaaugauaauacuauauguccucucaauugcuucacuuugcauaggccuaauaaccuuuaucucauucauaauaguagaaaaaaaacgaaacacauacuccagacuagaagacagacgaguuagacccacauccucaggugaccuauauuacauaggaacauaa

SEQ ID NO: 1536 - RNA, 1641 nt, Artificial Sequence
  derived and/or modified CDS sequence (opt6) from Nipah henipavirus__AAY43915__Nipah henipavirus__AAK50553__F(1-26)_F(27-546)
augguugucauacuagacaaaagaugcuacugcaauuuacuaauucuuauacuaaugauaucugaauguucuguaggaauacuccacuaugaaaaauuaucaaaaauaggauuagucaaaggaauaacaagaaaauauaaaaucaaaucaaauccccuaacaaaagauaucguaauuaaaaugauaccaaauguaucaaauaugagucaaugcaccggaagcguaauggaaaauuauaaaacacgcuuaaacggaauacuaaccccaaucaaaggagcuuuagaaauuuauaaaaacaacacacaugauuuaguaggcgauguaagacuagcaggcguaauuauggcuggcguugcaauaggaauagcuacagcugcccaaauaaccgcuggagucgcacucuaugaagcaaugaaaaacgcugacaacauaaauaaacuaaaaucaucaauagaaagcaccaaugaagccgucguaaaacuacaagaaacagcagaaaaaacaguauacguauuaaccgcuuuacaagacuauauaaauacuaacuuaguccccacaauugacaaaauuuccugcaaacagacagaacuaucacucgauuuagcauuaucaaaauacucuuccgacuuacuauucguauucgguccuaaucuacaagacccagucuccaacuccaugacuauccaagcaauaucccaagcauuuggaggaaauuaugaaacacucuuaagaacccucggauacgcaacagaaggcuucgaugaccuacucgaauccgacaguaucacaggacaaauaauauauguagacuuaucuggauacuauauaauaguaagaguauacuuuccaauucuaacagaaauacaacaagccuacauccaagaacuauuaccuguuucauuuaacaaugacaacuccgaauggauaucaauaguacccaauuucauccuuguuaggaacacccuaauauccaacauugaaaucggauuuuguuuaauaaccaaacgaucagucaucugcaaccaagauuaugcaacaccaaugaccaacaacaugagagaaugccuaacaggaucaacagaaaaauguccacgagaacuaguagucucaucccauguaccaagauucgccuuaucuaacgguguacuauucgcaaacugcaucaguguuaccugccaaugucaaaccacaggcagagccauaucucaaucuggagaacaaacacuacucaugauagacaauacaacuuguccaaccgcaguauuaggcaacguuauaauaucauuaggaaaauaccuaggaagugucaacuauaacucagaaggaauugcuauaggaccacccguauucacagauaaaguagacauauccucacaaauaucauccaugaaccaaucauuacaacaaucuaaagauuacauaaaagaagcacaaagacuauuagacacaguaaauccaucauuaauaucuaugcuaucaaugauaauacuauauguccucucaauugcuucacuuugcauaggccuaauaaccuuuaucucauucauaauaguagaaaaaaaacgaaacacauacuccagacuagaagacagacgaguuagacccacauccucaggugaccuauauuacauaggaacauaa

SEQ ID NO: 1537 - RNA, 1614 nt, Artificial Sequence
  derived and/or modified CDS sequence (opt11) from Nipah henipavirus__AAY43915__HsSPARC(1-17)_F(27-546)
augcgcgcguggauauucuuucucuugugcuuggccgggcgcgcgcucgcgauccuacacuacgaaaaacucuccaaaauaggccuaguuaaaggcaucacucgcaaauacaagauuaaauccaacccccucacaaaagacaucgucaucaaaaugauccccaaugucuccaacaugucccaaugcaccggcuccgucauggaaaacuacaaaacucgccucaacggaaucuuaacccccaucaaaggcgcgcucgagaucuacaaaaauaacacccacgaccugguaggcgacguccgacuugcuggagucauaauggccggcguagccaucggcaucgcaaccgcggcccaaaucaccgcagggguugcccucuacgaggccaugaaaaacgccgacaacauaaacaaacuaaaauccagcaucgaauccacuaacgaagccguaguaaaacuccaggaaacggccgagaaaaccgucuacguacuuacagcccuucaagauuacauaaauacgaaccucguccccaccaucgacaagaucucaugcaaacaaaccgaacucucccuugacuuagcgcucuccaaauacuccagcgaccuacucuucguauucgggccuaaccuccaagacccaguaagcaacuccaugaccauucaagcaauaucacaagccuucgggggcaacuaugaaacccuacucagaacccucggcuacgccaccgaaggcuucgacgaccuucuagaaucagacucuaucacuggccagauaaucuaugucgaccuaagcggauacuauauuauuguucgcgucuacuuccccauccucaccgaaauccagcaagccuacauacaggaacuccuccccgucagcuucaacaacgacaacuccgaauggaucuccaucguccccaacuucauccucguucgcaacacccuaauaucaaacaucgaaaucggcuucugccuaaucaccaaacgcuccgucauaugcaaccaggacuacgccaccccaaugaccaacaacaugcgcgaaugccucacaggcuccaccgagaaaugcccacgcgagcuaguugucuccucacacgucccccgcuucgcauuaucaaacggcguacucuucgcaaauugcaucuccgucacaugccaaugccaaaccacaggccgugccauaucacaaucaggcgaacaaacccuucucaugaucgacaauacaaccugccccaccgccguacucgguaaugucaucaucucacugggcaaauaccuaggaucagucaacuacaacucagaaggcaucgccaucggcccacccgucuucaccgauaaagucgacaucuccucucaaaucuccuccaugaaccaaucacuccaacagagcaaagacuacaucaaagaagcacaacgacuccucgacaccgucaaccccucccuaauauccaugcucucgaugaucauccucuacguacucuccauagccagccucugcaucggccuaaucaccuucaucagcuucauaauaguagaaaagaaacgcaacacauauucccgacuggaagacagacgcguccgucccacauccucaggagaccuguacuacaucggaaccuaa

SEQ ID NO: 1538 - RNA, 1617 nt, Artificial Sequence
  derived and/or modified CDS sequence (opt11) from Nipah henipavirus__AAY43915__HsCTRB2(1-18)_F(27-546)
auggccuuccucuggcuccucuccugcugggcccuccucggcaccaccuucggcauccuacacuacgaaaaacucuccaaaauaggccuaguuaaaggcaucacucgcaaauacaagauuaaauccaacccccucacaaaagacaucgucaucaaaaugauccccaaugucuccaacaugucccaaugcaccggcuccgucauggaaaacuacaaaacucgccucaacggaaucuuaacccccaucaaaggcgcgcucgagaucuacaaaaauaacacccacgaccugguaggcgacguccgacuugcuggagucauaauggccggcguagccaucggcaucgcaaccgcggcccaaaucaccgcagggguugcccucuacgaggccaugaaaaacgccgacaacauaaacaaacuaaaauccagcaucgaauccacuaacgaagccguaguaaaacuccaggaaacggccgagaaaaccgucuacguacuuacagcccuucaagauuacauaaauacgaaccucguccccaccaucgacaagaucucaugcaaacaaaccgaacucucccuugacuuagcgcucuccaaauacuccagcgaccuacucuucguauucgggccuaaccuccaagacccaguaagcaacuccaugaccauucaagcaauaucacaagccuucgggggcaacuaugaaacccuacucagaacccucggcuacgccaccgaaggcuucgacgaccuucuagaaucagacucuaucacuggccagauaaucuaugucgaccuaagcggauacuauauuauuguucgcgucuacuuccccauccucaccgaaauccagcaagccuacauacaggaacuccuccccgucagcuucaacaacgacaacuccgaauggaucuccaucguccccaacuucauccucguucgcaacacccuaauaucaaacaucgaaaucggcuucugccuaaucaccaaacgcuccgucauaugcaaccaggacuacgccaccccaaugaccaacaacaugcgcgaaugccucacaggcuccaccgagaaaugcccacgcgagcuaguugucuccucacacgucccccgcuucgcauuaucaaacggcguacucuucgcaaauugcaucuccgucacaugccaaugccaaaccacaggccgugccauaucacaaucaggcgaacaaacccuucucaugaucgacaauacaaccugccccaccgccguacucgguaaugucaucaucucacugggcaaauaccuaggaucagucaacuacaacucagaaggcaucgccaucggcccacccgucuucaccgauaaagucgacaucuccucucaaaucuccuccaugaaccaaucacuccaacagagcaaagacuacaucaaagaagcacaacgacuccucgacaccgucaaccccucccuaauauccaugcucucgaugaucauccucuacguacucuccauagccagccucugcaucggccuaaucaccuucaucagcuucauaauaguagaaaagaaacgcaacacauauucccgacuggaagacagacgcguccgucccacauccucaggagaccuguacuacaucggaaccuaa

SEQ ID NO: 1539 - RNA, 1641 nt, Artificial Sequence
  derived and/or modified CDS sequence (opt11) from Nipah henipavirus__AAY43915__Nipah henipavirus__AAK50553__F(1-26)_F(27-546)
auggucguaauacucgacaaacgcuguuacugcaaccuacuuauacucauccuuaugaucucagaaugcuccgucggcauccuacacuacgaaaaacucuccaaaauaggccuaguuaaaggcaucacucgcaaauacaagauuaaauccaacccccucacaaaagacaucgucaucaaaaugauccccaaugucuccaacaugucccaaugcaccggcuccgucauggaaaacuacaaaacucgccucaacggaaucuuaacccccaucaaaggcgcgcucgagaucuacaaaaauaacacccacgaccugguaggcgacguccgacuugcuggagucauaauggccggcguagccaucggcaucgcaaccgcggcccaaaucaccgcagggguugcccucuacgaggccaugaaaaacgccgacaacauaaacaaacuaaaauccagcaucgaauccacuaacgaagccguaguaaaacuccaggaaacggccgagaaaaccgucuacguacuuacagcccuucaagauuacauaaauacgaaccucguccccaccaucgacaagaucucaugcaaacaaaccgaacucucccuugacuuagcgcucuccaaauacuccagcgaccuacucuucguauucgggccuaaccuccaagacccaguaagcaacuccaugaccauucaagcaauaucacaagccuucgggggcaacuaugaaacccuacucagaacccucggcuacgccaccgaaggcuucgacgaccuucuagaaucagacucuaucacuggccagauaaucuaugucgaccuaagcggauacuauauuauuguucgcgucuacuuccccauccucaccgaaauccagcaagccuacauacaggaacuccuccccgucagcuucaacaacgacaacuccgaauggaucuccaucguccccaacuucauccucguucgcaacacccuaauaucaaacaucgaaaucggcuucugccuaaucaccaaacgcuccgucauaugcaaccaggacuacgccaccccaaugaccaacaacaugcgcgaaugccucacaggcuccaccgagaaaugcccacgcgagcuaguugucuccucacacgucccccgcuucgcauuaucaaacggcguacucuucgcaaauugcaucuccgucacaugccaaugccaaaccacaggccgugccauaucacaaucaggcgaacaaacccuucucaugaucgacaauacaaccugccccaccgccguacucgguaaugucaucaucucacugggcaaauaccuaggaucagucaacuacaacucagaaggcaucgccaucggcccacccgucuucaccgauaaagucgacaucuccucucaaaucuccuccaugaaccaaucacuccaacagagcaaagacuacaucaaagaagcacaacgacuccucgacaccgucaaccccucccuaauauccaugcucucgaugaucauccucuacguacucuccauagccagccucugcaucggccuaaucaccuucaucagcuucauaauaguagaaaagaaacgcaacacauauucccgacuggaagacagacgcguccgucccacauccucaggagaccuguacuacaucggaaccuaa

SEQ ID NO: 1540 - RNA, 1831 nt, Artificial Sequence
  mRNA product Design1 comprising derived and/or modified sequence from Nipah henipavirus__AAY43915__HsSPARC(1-17)_F(27-546) (opt1)
gggagaaagcuuaccaugcgcgccuggaucuucuuccugcucugccuggccggccgggcccuggccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1541 - RNA, 1834 nt, Artificial Sequence
  mRNA product Design1 comprising derived and/or modified sequence from Nipah henipavirus__AAY43915__HsCTRB2(1-18)_F(27-546) (opt1)
gggagaaagcuuaccauggccuuccuguggcuccugagcugcugggcccugcucggcaccaccuucgggauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1542 - RNA, 1858 nt, Artificial Sequence
  mRNA product Design1 comprising derived and/or modified sequence from Nipah henipavirus__AAY43915__Nipah henipavirus__AAK50553__F(1-26)_F(27-546) (opt1)
gggagaaagcuuaccaugguggucauccuggacaagcgcugcuacugcaaccuccugauccugauccucaugaucagcgagugcuccgugggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1543 - RNA, 1996 nt, Artificial Sequence
  mRNA product Design2 comprising derived and/or modified sequence from Nipah henipavirus__AAY43915__HsSPARC(1-17)_F(27-546) (opt1)
ggggcgcugccuacggagguggcagccaucuccuucucggcaucaagcuuaccaugcgcgccuggaucuucuuccugcucugccuggccggccgggcccuggccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1544 - RNA, 1999 nt, Artificial Sequence
  mRNA product Design2 comprising derived and/or modified sequence from Nipah henipavirus__AAY43915__HsCTRB2(1-18)_F(27-546) (opt1)
ggggcgcugccuacggagguggcagccaucuccuucucggcaucaagcuuaccauggccuuccuguggcuccugagcugcugggcccugcucggcaccaccuucgggauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1545 - RNA, 2023 nt, Artificial Sequence
  mRNA product Design2 comprising derived and/or modified sequence from Nipah henipavirus__AAY43915__Nipah henipavirus__AAK50553__F(1-26)_F(27-546) (opt1)
ggggcgcugccuacggagguggcagccaucuccuucucggcaucaagcuuaccaugguggucauccuggacaagcgcugcuacugcaaccuccugauccugauccucaugaucagcgagugcuccgugggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1546 - RNA, 1796 nt, Artificial Sequence
  mRNA product Design3 comprising derived and/or modified sequence from Nipah henipavirus__AAY43915__HsSPARC(1-17)_F(27-546) (opt1)
gggagaaagcuuaccaugcgcgccuggaucuucuuccugcucugccuggccggccgggcccuggccauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1547 - RNA, 1799 nt, Artificial Sequence
  mRNA product Design3 comprising derived and/or modified sequence from Nipah henipavirus__AAY43915__HsCTRB2(1-18)_F(27-546) (opt1)
gggagaaagcuuaccauggccuuccuguggcuccugagcugcugggcccugcucggcaccaccuucgggauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1548 - RNA, 1823 nt, Artificial Sequence
  mRNA product Design3 comprising derived and/or modified sequence from Nipah henipavirus__AAY43915__Nipah henipavirus__AAK50553__F(1-26)_F(27-546) (opt1)
gggagaaagcuuaccaugguggucauccuggacaagcgcugcuacugcaaccuccugauccugauccucaugaucagcgagugcuccgugggcauccugcacuacgagaagcuguccaagaucgggcucgugaagggcaucacccggaaguacaagaucaagagcaacccccugaccaaggacaucgugaucaagaugaucccgaacgucuccaacaugagccagugcacgggguccgugauggagaacuacaagacccgccugaacggcauccucacccccaucaagggggcccuggagaucuacaagaacaacacccacgaccuggugggcgacguccggcucgcgggcgugaucauggccgggguggccaucggcaucgccacggccgcgcagaucaccgccggggucgcccuguacgaggccaugaagaacgcggacaacaucaacaagcucaagagcuccaucgagagcaccaacgaggccguggugaagcuccaggagaccgccgagaagacggucuacgugcugaccgcccugcaggacuacaucaacaccaaccucgugcccaccaucgacaagaucuccugcaagcagacggagcugagccuggaccucgcccuguccaaguacagcuccgaccugcuguucgucuucggccccaaccugcaggacccggugagcaacuccaugaccauccaggcgaucagccaggccuucgggggcaacuacgagacccugcuccgcacccugggcuacgccacggagggguucgacgaccugcucgaguccgacagcaucaccggccagaucaucuacguggaccugagcggguacuacaucaucguccggguguacuuccccauccugaccgagauccagcaggccuacauccaggagcuccugcccguguccuucaacaacgacaacagcgaguggaucuccaucguccccaacuucauccuggugcgcaacacccucaucagcaacaucgagaucggcuucugccugaucacgaagcgguccgugaucugcaaccaggacuacgccaccccgaugaccaacaacaugcgcgagugccugaccggcagcacggagaagugcccccgggagcucgucguguccagccacgucccccgcuucgcgcuguccaacggggugcuguucgccaacugcaucagcgugaccugccagugccagaccaccggccgggccaucucccagagcggggagcagacgcuccugaugaucgacaacacgaccugccccaccgccguccugggcaacgugaucaucucccucgggaaguaccugggcagcgugaacuacaacuccgagggcaucgccaucgggccgcccgucuucaccgacaagguggacaucagcucccagaucagcuccaugaaccagagccugcagcagagcaaggacuacaucaaggaggcgcagcgccuccuggacaccgugaaccccucccugaucagcaugcuguccaugaucauccucuacguccugagcaucgccucccugugcaucggccucaucaccuucaucagcuucaucaucguggagaagaagcggaacaccuacucccgccuggaggaccggcgcgugcggcccacgagcuccggggaccuguacuacaucggcaccugaggacuaguuauaagacugacuagcccgaugggccucccaacgggcccuccuccccuccuugcaccgagaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

The invention claimed is:

1. A method of treating or preventing a disorder, wherein the method comprises applying or administering to a subject in need thereof an effective amount of a composition comprising a RNA comprising at least one coding sequence encoding a Nipah virus fusion protein F:
   (a) at least about 95% identical to the sequence of SEQ ID NO: 1 and wherein the Nipah virus fusion protein F is encoded by a RNA coding sequence at least about 95% identical to SEQ ID NO: 53; or
   (b) at least about 95% identical to the sequence of SEQ ID NO: 573 and wherein the Nipah virus fusion protein F is encoded by a RNA coding sequence at least about 95% identical to SEQ ID NO: 625.

2. The method according to claim 1, wherein the at least one coding sequence encodes a Nipah virus fusion protein F at least about 95% identical to the sequence of SEQ ID NO: 573.

3. The method according to claim 2, wherein the at least one coding sequence encodes a Nipah virus fusion protein F identical to the sequence of SEQ ID NO: 573.

4. The method according to claim 1, wherein the RNA encodes a Nipah virus fusion protein F identical or at least 95% identical to SEQ ID NO: 1.

5. The method according to claim 1, wherein the RNA encodes at least one further protein element selected from a secretory signal peptide, a transmembrane domain, a VLP forming domain, a peptide linker, a self-cleaving peptide, an immunologic adjuvant sequence, and/or a dendritic cell targeting sequence.

6. The method according to claim 1, wherein the RNA is bicistronic or multicistronic.

7. The method according to claim 1, wherein the RNA is a mRNA.

8. The method according to claim 1, wherein the G/C content of the at least one coding sequence is increased compared to the G/C content of the corresponding wild type coding sequence, and/or wherein the C content of the at least one coding sequence is increased compared to the C content of the corresponding wild type coding sequence and/or wherein the codons in the at least one coding sequence are adapted to human codon usage, wherein the codon adaptation index (CAI) is increased or maximised in the at least one coding sequence, wherein the amino acid sequence encoded by the at least one coding sequence is not modified compared to the amino acid sequence encoded by the corresponding wild type coding sequence.

9. The method according to claim 1, wherein the RNA comprises an untranslated region (UTR).

10. The method according to claim 1, comprising a plurality of RNA molecules encoding different antigenic protein.

11. The method according to claim 10, wherein (i) each of the RNA molecules encodes a different antigenic protein derived from a Henipavirus and/or Hendra virus and/or Nipah virus; (ii) each of the RNA molecules encodes a different antigenic protein derived from genetically the same Henipavirus and/or Hendra virus and/or Nipah virus; or (iii) each of the RNA molecules encodes a different antigenic protein derived from a genetically different Henipavirus and/or Hendra virus and/or Nipah virus.

12. The method according to claim 1, wherein RNA is complexed with one or more cationic or polycationic component.

13. The method according to claim 1, wherein the artificial nucleic acid is complexed with one or more polysaccharides.

14. The method according to claim 1, wherein the RNA is complexed with one or more lipids, thereby forming liposomes, lipid nanoparticles and/or lipoplexes.

15. The method according to claim 1, wherein the composition comprises at least one adjuvant component.

16. The method according to claim 1, wherein the RNA comprises in 5' to 3' direction, the following elements a)-g):
   a) 5'-cap structure;
   b) optionally, 5'-UTR element;
   c) at least one coding sequence encoding the Nipah virus fusion protein F;
   d) a 3'-UTR element;
   e) optionally, poly(A) sequence;
   f) optionally, poly(C) sequence; and
   g) optionally, a histone stem-loop.

17. The method according to claim 16, wherein the RNA comprises, in the 5' to 3' direction, the following elements a)-g):
   a) 5'-cap structure;
   b) a 5'-UTR element;
   c) the at least one coding sequence encoding the Nipah virus fusion protein F;
   d) a 3'-UTR element;
   e) a poly(A) sequence;
   f) optionally, poly(C) sequence; and
   g) optionally, a histone stem-loop.

18. The method according to claim 12, wherein the cationic or polycationic component is a cationic or polycationic polymer, a cationic or polycationic peptide or protein, or a cationic or polycationic lipid.

19. The method according to claim 12, wherein the cationic or polycationic peptide or protein is a protamine.

* * * * *